(12) United States Patent
Glazebrook et al.

(10) Patent No.: US 7,777,097 B2
(45) Date of Patent: Aug. 17, 2010

(54) PLANT DISEASE RESISTANCE GENES

(75) Inventors: Jane Glazebrook, San Diego, CA (US); Steven P. Briggs, Del Mar, CA (US); Bret Cooper, La Jolla, CA (US); Stephen A. Goff, Research Triangle Park, NC (US); Todd Moughamer, Research Triangle Park, NC (US); Fumiyaki Katagiri, Research Triangle Park, NC (US); Joel Kreps, San Diego, CA (US); Nicholas Provart, Toronto (CA); Darrell Ricke, Research Triangle Park, NC (US); Tong Zhu, Research Triangle Park, NC (US)

(73) Assignee: Syngenta Participations AG, Basel (CH)

( * ) Notice: Subject to any disclaimer, the term of this patent is extended or adjusted under 35 U.S.C. 154(b) by 1172 days.

(21) Appl. No.: 10/482,526

(22) PCT Filed: Jun. 21, 2002

(86) PCT No.: PCT/IB02/02453

§ 371 (c)(1),
(2), (4) Date: Nov. 13, 2006

(87) PCT Pub. No.: WO03/000906

PCT Pub. Date: Jan. 3, 2003

(65) Prior Publication Data

US 2007/0089180 A1    Apr. 19, 2007

Related U.S. Application Data

(60) Provisional application No. 60/366,535, filed on Mar. 22, 2002, provisional application No. 60/325,277, filed on Sep. 26, 2001, provisional application No. 60/300,112, filed on Jun. 22, 2001.

(51) Int. Cl.
*C12N 15/09* (2006.01)
*C12N 15/82* (2006.01)
*A01H 5/00* (2006.01)

(52) U.S. Cl. .............. 800/279; 800/278; 800/298; 800/320; 800/320.1; 800/320.2; 800/320.3; 800/312; 800/314; 800/322; 800/317.3; 435/468

(58) Field of Classification Search ............. None
See application file for complete search history.

(56) References Cited

U.S. PATENT DOCUMENTS 6,274,789 B1 * 8/2001 Yano et al. ............ 800/279
7,365,185 B2 * 4/2008 Boukharov et al. ....... 536/24.1

FOREIGN PATENT DOCUMENTS

EP    1033405 A2    9/2000
WO    WO 00/08187    2/2000

OTHER PUBLICATIONS

Fourgoux-Nicol et al (1999). Plant Molecular Biology 40: 857-872.*
International Preliminary Examination Report for PCT International Application No. PCT/IB02/02453 dated Aug. 12, 2003.
Written Opinion for PCT International Application No. PCT/IB02/02453 dated Aug. 21, 2003.
Notification of Transmittal of International Search Report for PCT International Application No. PCT/IB02/02453 dated Aug. 12, 2003.
XP-002242381 Database EMBL11, Lee M.C. et al. "Large-scale sequencing analysis of ESTs from Rice Seedling" (Jul. 2000).
XP-002242370 Database EMBL9, Sato S. et al., "*Arabidopsis thaliana* genomic DNA, chromosome 3, TAC clone:K5K13" (Apr. 1999).
Sato et al., Structural Analysis of *Arabidopis thaliana* Chromosome 3.I. Sequence Features of the Regions of 4,504,864 bp Covered by Sixty P1 and TAC Clones, *DNA Research*, 7:131-135 (2000).
XP-002242371 Database EMBL "*Arabidopsis thaliana* DAN fragment SEQ ID No. 63269" (Oct. 18, 2000).
Ilag et al., Isolation and characterization of disease resistance gene homologues from rice cultivar IR64, *Gene* 255(2):245-255 (Sep. 19, 2000).
Reuber et al., Isolation of *Arabidopsis* Genes that Differentiate between Resistance Responses Mediated by the RPS2 and RPM1 Disease Resistance Genes, *The Plant Cell* 8:241-249 (Feb. 1996).

* cited by examiner

*Primary Examiner*—Medina A Ibrahim
(74) *Attorney, Agent, or Firm*—Karen Moon Bruce

(57) ABSTRACT

The invention relates to methods of producing plants with increased resistance to pathogen infection by expressing disease resistance genes in the plants and transgenic plants having enhanced pathogen resistance.

11 Claims, No Drawings

PLANT DISEASE RESISTANCE GENES

This is a national stage application under 35 U.S.C. §371 of International Application No. PCT/IB02/02453, filed on Jun. 21, 2002, which is entitled to the benefit of U.S. Application No. 60/366,535, filed on Mar. 22, 2002, U.S. Application No. 60/352,277, filed on Sep. 26, 2001, and U.S. Application No. 60/300,112, filed on Jun. 22, 2001, which are incorporated herein by reference in their entireties.

The Sequence Listing associated with the instant disclosure has been submitted as a 2.45 MB file on CD-R (in duplicate) instead of on paper. Each CD-R is marked in indelible ink to identify the Applicants, Title, File Name (70034USPCTSEQ.txt), Creation Date (Dec. 18, 2003), Computer System (IBM-PC/MS-DOS/MS-Windows). The Sequence Listing submitted on CD-R is hereby incorporated by reference into the instant disclosure.

The present invention generally relates to the field of plant molecular biology, and more specifically to the regulation of gene expression in plants in response to pathogen exposure, and even more particularly to genes and polypeptides related to disease resistance ($DIS^R$).

Plants are capable of activating a large array of defense mechanisms in response to pathogen attack, some of which are preexisting and others are inducible. Pathogens must specialize to circumvent the defense mechanisms of the host, especially those biotrophic pathogens that derive their nutrition from an intimate association with living plant cells. If the pathogen can cause disease, the interaction is said to be compatible, but if the plant is resistant, the interaction is said to be incompatible. A crucial factor determining the success of these mechanisms is the speed of their activation. Consequently, there is considerable interest in understanding how plants recognize pathogen attack and control expression of defense mechanisms.

Some potential pathogens trigger a very rapid resistance response called gene-for-gene resistance. This occurs when the pathogen carries an a virulence (avr) gene that triggers specific recognition by a corresponding host resistance (R) gene. R gene specificity is generally quite narrow, in most cases only pathogens carrying a particular avr gene are recognized. Recognition is thought to be mediated by ligand-receptor binding. R genes have been studied extensively in recent years. For a review of R genes, see Ellis et al. (1998); Jones et al. (1997); and Ronald (1998).

One of the defense mechanisms triggered by gene-for-gene resistance is programmed cell death at the infection site. This is called the hypersensitive response, or HR. Pathogens that induce the H, or cause cell death by other means, activate a systemic resistance response called systemic acquired resistance (SAR). During SAR, levels of salicylic acid (SA) rise throughout the plant, defense genes such as pathogenesis related (PR) genes are expressed, and the plant becomes more resistant to pathogen attack. SA is a crucial component of this response. Plants that cannot accumulate SA due to the presence of a transgene that encodes an SA-degrading enzyme (nahG), develop a HR in response to challenge by avirulent pathogens, but do not exhibit systemic expression of defense genes and do not develop resistance to subsequent pathogen attack (Ryals et al., 1996). The nature of the systemic signal that triggers SAR is a subject of debate (Shulaev et al., 1995; Vernooji et al., 1994). SA clearly moves from the site of the HR to other parts of the plant, but if this is the signal, it must be effective at extremely low concentration (Willitset et al., 1998).

SAR is quite similar to some reactions that occur locally in response to attack by virulent (those that cause disease) or avirulent (those that trigger gene-for-gene resistance) pathogens. In general, activation of defense gene expression occurs more slowly in response to virulent pathogens than in response to avirulent pathogens. Some pathogens trigger expression of defense genes through a different signaling pathway that requires components of the jasmonic acid (JA) and ethylene signaling pathways (Creelman et al., 1997).

One approach to understanding the signal transduction networks that control defense mechanisms is to use genetic methods to identify signaling components and determine their roles within the network. Considerable progress has been made using this approach in *Arabidopsis*-pathogen model systems.

SA-Dependent Signaling

SA levels increase locally in response to pathogen attack, and systemically in response to the SAR-inducing signal. SA is necessary and sufficient for activation of PR gene expression and enhanced disease resistance. Physiological analyses and characterization of certain lesion-mimic mutants strongly suggest that there is a positive autoregulatory loop affecting SA concentrations (Shirasu et al., 1997; Hunt et al., 1997; Weymann et al., 1995). Several mutants with defects in SA signaling have been characterized. These include npr1, in which expression of PR genes in response to SA is blocked; cpr1, cpr5, and cpr6, which constitutively express PR genes; the npr1 suppressor ssi1; pad4, which has a defect in SA accumulation; and eds5, which has a defect in PR1 expression.

Expression of the defense genes PR1, BG2, and PR5 in response to SA treatment requires a gene called NPR1 or NIM1. Mutations in npr1 abolish SAR, and cause enhanced susceptibility to infection by various pathogens (Cao et al., 1994; Delaney et al., 1995; Glazebrook et al., 1996; Shah et al., 1997). NPR1 appears to be a positive regulator of PR gene expression that acts downstream from SA. NPR1 encodes a novel protein that contains ankyrin repeats (which are often involved in protein-protein interactions (Cao et al., 1997; Ryals et al., 1997), and that is localized to the nucleus in the presence of SA (Dong et al., 1998). Consequently, it is unlikely that NPR1 acts as a transcription factor to directly control PR gene expression, but its nuclear localization suggests that it may interact with such transcription factors.

PAD4 appears to act upstream from SA. In pad4 plants infected with a virulent *P. syringae* strain, SA levels, synthesis of the antimicrobial compound camalexin, and PR1 expression are all reduced (Zhou et al., 1998). SA is necessary, but not sufficient, for activation of camalexin synthesis (Zhou et al., 1998; Zhao et al., 1996). The camalexin defect in pad4 plants is reversible by exogenous SA (Zhou et al., 1998). Mutations in pad4 do not affect SA levels, camalexin synthesis, or PR1 when plants are infected with an avirulent *P. syringae* strain (Zhou et al., 1998). Taken together, these results suggest that PAD4 is required for signal amplification to activate the SA pathway in response to pathogens that do not elicit a strong defense response (Zhou et al., 1998).

JA-Dependent Signaling

JA signaling affects diverse processes including fruit ripening, pollen development, root growth, and response to wounding (Creelman et al., 1997). The jar1 and coi1 mutants fail to respond to JA (Feys et al., 1994; Staswick et al., 1992). COI1 has been cloned, and found to encode protein containing leucine-rich repeats and a degenerate F-box motif (Xie et al., 1998). These features are characteristic of proteins that function in complexes that ubiquitinate protein targeted for degradation.

In the past few years it has become apparent that JA plays an important role in regulation of pathogen defenses. For example, the induction of the defensin gene PDF1.2 after inoculation of *Arabidopsis* with the avirulent pathogen *Alternaria brassicicola* does not require SA or NPR1, but does require ethylene and JA signaling (Penninck et al., 1996).

SA signaling and JA signaling pathways are interconnected in complicated ways. Studies in other systems have shown that SA signaling and JA signaling are mutually inhibitory (Creelman et al., 1997; Harms et al., 1998). However, synthesis of camalexin in response to *P. syringae* infection is blocked in nahG (Zhou et al., 1998; Zhao et al., 1996) and coi1 (Glazebrook, 1999) plants, strongly suggesting that camalexin synthesis requires both SA and JA signaling.

Induced Systemic Resistance (ISR)

Some rhizosphere-associated bacteria promote disease resistance (van Loon et al., 1998). This phenomenon, called ISR, has been studied using *Pseudomonas fluorescens* strain WCS417r to colonize *Arabidopsis* roots (Pieterse et al., 1996). Colonized plants are more resistant to infection by the fungal pathogen *Fusarium oxysporum* f sp *raphani* and *P. syringae* (Pieterse et al., 1996). ISR occurs in nahG plants, indicating that it is not a SA-dependent phenomenon (Pieterse et al., 1996). Rather, ISR appears to be JA- and ethylene-dependent. The observation that ethylene can induce ISR in jar1 mutants led to the hypothesis that ISR requires a JA signal followed by an ethylene signal (Pieterse et al., 1998). No changes in gene expression associated with ISR have been detected (Pieterse et al., 1998), suggesting that it is different from activation of PDF1.2 expression by *A. brassicicola*.

Curiously, ISR requires NPR1 (Pieterse et al., 1996). This is unexpected in light of the fact that NPR1 is previously known to be involved only in SA-dependent processes and ISR is SA-independent. If the SA-dependent signal is received, NPR1 mediates a resistance response characterized by PR1 expression, whereas if the ISR signal is received, NPR1 mediates a different resistance response. It is difficult to imagine how this could occur, unless NPR1 is interacting with different 'adapter' molecules to mediate the different signals. The ankyrin repeats found in NPR1 could function in protein-protein interactions between NPR1 and adapter proteins. Identification of proteins that interact with NPR1, and characterization of plants with loss-of-function mutations affecting those proteins, would be very helpful for understanding how NPR1 acts in each pathway. It would also be worthwhile to determine if the ssi1 or cpr6 mutations suppress the ISR defect of npr1 mutants.

Relevance to Disease Resistance

Characterization of the effects of various mutations on resistance to different pathogens has revealed that there is considerable variation in the extent to which pathogens are affected by defense mechanisms. SAR is known to confer resistance to a wide array of pathogens, including bacteria, fungi, oomycetes, and viruses. JA signaling is important for limiting the growth of certain fungal pathogens. In *Arabidopsis*, the SA pathway mutants npr1 and pad4 show enhanced susceptibility to *P. syringae* and *P. parasitica* (Cao et al., 1994; Delaney et al., 1995; Shah et al., 1997; Zhou et al., 1998; Glazebrook et al., 1997).

Overexpression of rate-limiting defense response regulators may cause the signaling network to respond faster or more strongly to pathogen attack, thereby improving resistance. For example, overexpression of NPR1 caused increased resistance to *P. syringae* and *P. parasitica* in a dosage dependent manner (Cao et al., 1998). Moreover, NPR1-overexpression had no obvious deleterious effects on plant growth, in contrast to mutations that lead to constitutive overexpression of defense responses, which generally cause dwarfism.

Thus, what is needed is the identification of plant genes useful to confer resistance to a pathogen(s).

The invention generally provides an isolated nucleic acid molecule (polynucleotide) comprising a plant nucleotide sequence obtained or isolatable from a gene, the expression of which is altered, either increased or decreased, in response to pathogen infection (a $DIS^R$ gene). As used herein, a "pathogen" includes bacteria, fungi, oomycetes, viruses, nematodes and insects, e.g., aphids (see Hammond-Kosack and Jones, 1997). The expression of a plant nucleotide sequence of the invention comprising an open reading frame may be useful to confer tolerance or resistance of a plant to one or more species of bacteria, nematode, fungi, oomycete, virus or insect.

The nucleotide sequence preferably is obtained or isolatable from plant DNA. In particular, the nucleotide sequence is obtained or isolatable from a gene encoding a polypeptide which is substantially similar, and preferably has at least 70%, e.g., 71%, 72%, 73%, 74%, 75%, 76%, 77%, 78%, 79%, 80%, 81%, 82%, 83%, 84%, 85%, 86%, 87%, 88%, 89%, and even 90% or more, e.g., 91%, 92%, 93%, 94%, 95%, 96%, 97%, 98%, and 99%, amino acid sequence identity, to a polypeptide comprising any one of *SEQ ID NOs: 8540, 10048, 22074, 22946, 30016, 30018, 30020, 31554, 43056, 45398, 58036, 69038, 73648, 77042, 89655, 97492, 135198, 150008, 150016, 150042, 150052, 150070, 150074, 150078, 150080, 150082, 150092, 150110, 150118, 150128, and 150133; *SEQ ID NOs:3436, 4752, 5006, 6464, 7232, 8226, 8376, 9486, 10450, 10700, 17488, 17652, 18456, 19446, 19622, 21090, 22026, 22442, 22640, 24936, 25430, 26010, 26414, 26616, 27106, 27722, 28508, 28788, 28956, 30014, 30322, 32248, 32848, 33234, 33278, 34580, 35554, 35754, 35956, 36374, 36458, 36888, 38050, 38490, 38668, 39118, 39382, 39614, 42322, 42494, 42620, 42850, 42936, 43056, 43898, 44538, 45398, 45966, 49248, 49656, 49864, 52964, 53446, 54224, 55308, 55340, 56756, 58170, 60452, 61318, 61500, 61706, 62146, 62282, 64532, 65606, 65634, 68062, 68706, 69012, 69300, 69420, 69812, 70846, 72290, 73266, 73268, 73540, 73780, 74586, 74702, 75652, 76010, 76290, 76308, 76628, 78988, 80478, 80666, 84534, 86398, 87066, 88326, 90314, 90656, 91344, 92284, 93708, 95714, 96620, 97704, 97992, 100350, 101634, 103296, 105620, 105750, 106006, 106920, 107382, 109508, and 110824; and/or *SEQ ID NOs:3436, 4516, 4752, 4806, 5006, 6464, 7232, 8226, 8376, 8558, 9486, 9489, 10450, 10700, 14894, 17488, 17652, 18420, 18456, 18572, 18722, 19446, 19484, 19622, 21030, 21090, 21746, 22026, 22442, 22640, 24650, 24936, 25430, 25788, 26010, 26414, 26616, 27106, 27354, 27564, 27722, 27918, 28508, 28788, 28956, 29356, 30014, 30322, 31410, 31412, 32248, 32848, 33234, 33248, 33278, 34478, 34580, 34585, 35554, 35754, 35956, 36374, 36458, 36888, 37004, 37038, 37438, 37750, 38050, 38490, 38668, 39118, 39308, 39382, 39614, 40528, 40722, 41192, 41816, 42034, 42322, 42494, 42620, 42850, 42936, 42982, 43056, 43898, 44538, 45398, 45434, 45966, 46086, 47618, 49248, 49656, 49864, 52886, 52964, 53446, 55318, 54224, 55308, 55340, 55642, 56126, 56756, 57640, 58035, 58170, 59792, 60452, 61318, 61500, 61706, 62146, 62282, 62618, 64064, 64532, 65606, 65634, 65956, 66502, 68062, 68266, 68338, 68706, 69012, 69300, 69420, 69676, 69812, 70846, 72290, 73046, 73266, 73268, 73540, 73780, 74586, 74702, 75652, 76010, 76290, 76308, 76628, 78850, 78988, 80478, 80666, 81460, 81754, 84534, 86398, 86478, 87066, 88326, 90314, 90656, 91344, 92284, 92544, 92828, 93708, 94924, 95688, 95714, 96620, 97704, 97992, 99942, 100350, 100960, 102228, 102288, 104196, 105168, 105712, 106038, 107106, 107212, 107272, 110580, 110962, 128178, 129300, 129486, 135130, 135146, 135208, 150002, 150004, 150006, 150010, 150012, 150014, 150018, 150020, 150022, 150024, 150026, 150028, 150030, 150032, 150034, 150036; 150038, 150040, 150042, 150044, 150046, 150048, 150054, 150056, 150058, 150060, 150062, 150064, 150066, 150068, 150070, 150072, 150076, 150084, 150086, 150088, 150090, 150092, 150094, 150096, 150098, 150100, 150102, 150104, 150106, 150108, 150112, 150114, 150116, 150120, 150122, 150124, 150126, 150130, and 150132, which correspond to SEQ ID NOs: 2 to 568 provided in the Sequence Listing, and/or SEQ ID NOs: 570-624, and/or SEQ ID NOs: 626-672, and/or SEQ ID NOs: 674-826, or a partial-length polypeptide having substantially the same activity as the full-length polypeptide, e.g., at least 50%, more preferably at least 80%, even more preferably at least 90% to 95% the activity of the full-length polypeptide, or to a polypeptide encoded by a DIS$^R$ gene of the invention comprising an open reading frame comprising any one of *SEQ ID NOs:8539, 10047, 22073, 22945, 30015, 30017, 30019, 31553, 43055, 45397, 58035, 69037, 73647, 77041, 89655, 97491, 135197, 150007, 150015, 150041, 150051, 150069, 150073, 150077, 150079, 150081, 150091, 150109, 150117, 150127, and 150133; *SEQ ID NOs:3435, 4751, 5005, 6463, 7231, 8225, 8375, 9485, 10449, 10699, 17487, 17651, 18455, 19445, 19621, 21089, 22025, 22441, 22639, 24935, 25429, 26009, 26413, 26615, 27105, 27721, 28507, 28787, 28955, 30013, 30321, 32247, 32847, 33233, 33277, 34579, 35553, 35753, 35955, 36373, 36457, 36887, 38049, 38489, 38667, 39117, 39381, 39613, 42321, 42493, 42619, 42849, 42935, 43055, 43897, 44537, 45397, 45965, 49247, 49655, 49863, 52963, 53445, 54223, 55307, 55339, 56755, 58169, 60451, 61317, 61499, 61705, 62145, 62281, 64531, 65605, 65633, 68061, 68705, 69011, 69299, 69419, 69811, 70845, 72289, 73265, 73267, 73539, 73779, 74585, 74701, 75651, 76009, 76289, 76307, 76627, 78987, 80477, 80665, 84533, 86397, 87065, 88325, 90313, 90655, 91343, 92283, 93707, 95713, 96619, 97703, 97991, 100349, 101633, 103295, 105619, 105749, 106005, 106919, 107381, 109507, and 110823; and/or *SEQ ID NOs:3435, 4515, 4751, 4805, 5005, 6463, 7231, 8225, 8375, 8557, 9485, 9489, 10449, 10699, 14893, 17487, 17651, 18419, 18455, 18571, 18721, 19445, 19483, 19621, 21029, 21089, 21745, 22025, 22441, 22639, 24649, 24935, 25429, 25787, 26009, 26413, 26615, 27105, 27353, 27563, 27721, 27917, 28507, 28787, 28955, 29355, 29371, 30013, 30321, 31409, 31419, 32247, 32847, 33233, 33247, 33277, 34477, 34579, 34585, 35553, 35753, 35955, 36373, 36457, 36887, 37003, 37037, 37437, 37749, 38049, 38489, 38667, 39117, 39307, 39347, 39381, 39613, 40527, 40721, 41191, 41815, 42033, 42321, 42493, 42619, 42849, 42935, 42981, 43055, 43897, 44537, 45397, 45433, 45965, 46085, 47617, 49247, 49655, 49863, 52885, 52963, 53445, 54223, 55307, 55317, 55339, 55641, 56125, 56755, 57639, 58035, 58169, 59791, 60451, 61317, 61499, 61705, 62145, 62281, 62617, 64063, 64531, 65605, 65633, 65955, 66561, 68061, 68265, 68337, 68705, 69011, 69299, 69419, 69675, 69811, 70845, 72289, 73045, 73265, 73267, 73539, 73779, 74585, 74701, 75651, 76009, 76289, 76307, 76627, 78849, 78987, 80477, 80665, 81459, 81753, 84533, 86397, 86477, 87065, 88325, 90313, 90655, 91343, 92283, 92543, 92927, 93707, 94923, 95687, 95713, 96619, 97703, 97991, 99941, 100349, 100959, 102227, 102287, 104075, 104195, 104479, 105167, 105711, 106037, 107105, 107211, 107271, 110579, 110961, 128177, 129299, 129485, 135129, 135145, 135207, 150001, 150003, 150005, 150009, 150011, 150013, 150017, 150019, 150021, 150023, 150025, 150027, 150029, 150031, 150033, 150035, 150037, 150039, 150041, 150043, 150045, 150047, 150053, 150055, 150057, 150059, 150061, 150063, 150065, 150067, 150069, 150071, 150075, 150083, 150085, 150087, 150089, 150091, 150093, 150095, 150097, 150099, 150101, 150103, 150105, 150107, 150111, 150113, 150115, 150119, 150121, 150123, 150125, 150129, and 15013, which correspond to SEQ ID NOs: 1 to 567 provided in the Sequence Listing, and/or SEQ ID NOs: 569-623, and/or SEQ ID NOs: 625-671, and/or SEQ ID NOs: 673-825, the complement thereof, or a fragment (portion) thereof which encodes a partial-length polypeptide having substantially the same activity as the full-length polypeptide or a fragment useful to prepare a construct or vector to decrease or eliminate expression of the corresponding endogenous gene.

The invention also provides uses for an isolated nucleic acid molecule, e.g., DNA or RNA, comprising a plant nucleotide sequence comprising an open reading frame encoding a polypeptide which is substantially similar, and preferably has at least 70%, e.g., 71%, 72%, 73%, 74%, 75%, 76%, 77%, 78%, 79%, 80%, 81%, 82%, 83%, 84%, 85%, 86%, 87%, 88%, 89%, and even 90% or more, e.g., 91%, 92%, 93%, 94%, 95%, 96%, 97%, 98%, and 99%, amino acid sequence identity, to a polypeptide comprising any one of *SEQ ID NOs:8540, 10048, 22074, 22946, 30016, 30018, 30020, 31554, 43056, 45398, 58036, 69038, 73648, 77042, 89655, 97492, 135198, 150008, 150016, 150042, 150052, 150070, 150074, 150078, 150080, 150082, 150092, 150110, 150118, 150128, and 150133; *SEQ ID NOs:3436, 4752, 5006, 6464, 7232, 8226, 8376, 9486, 10450, 10700, 17488, 17652, 18456, 19446, 19622, 21090, 22026, 22442, 22640, 24936, 25430, 26010, 26414, 26616, 27106, 27722, 28508, 28788, 28956, 30014, 30322, 32248, 32848, 33234, 33278, 34580, 35554, 35754, 35956, 36374, 36458, 36888, 38050, 38490, 38668, 39118, 39382, 39614, 42322, 42494, 42620, 42850, 42936, 43056, 43898, 44538, 45398, 45966, 49248, 49656, 49864, 52964, 53446, 54224, 55308, 55340, 56756, 58170, 60452, 61318, 61500, 61706, 62146, 62282, 64532, 65606, 65634, 68062, 68706, 69012, 69300, 69420, 69812, 70846, 72290, 73266, 73268, 73540, 73780, 74586, 74702, 75652, 76010, 76290, 76308, 76628, 78988, 80478, 80666, 84534, 86398, 87066, 88326, 90314, 90656, 91344, 92284, 93708, 95714, 96620, 97704, 97992, 100350, 101634, 103296, 105620, 105750, 106006, 106920, 107382, 109508, and 110824; and/or *SEQ ID NOs:3436, 4516, 4752, 4806, 5006, 6464, 7232, 8226, 8376, 8558, 9486, 9489, 10450, 10700, 14894, 17488, 17652, 18420, 18456, 18572, 18722, 19446, 19484, 19622, 21030, 21090, 21746, 22026, 22442, 22640, 24650, 24936, 25430, 25788, 26010, 26414, 26616, 27106, 27354, 27564, 27722, 27918, 28508, 28788, 28956, 29356, 30014, 30322, 31410, 31412, 32248, 32848, 33234, 33248, 33278, 34478, 34580, 34585, 35554, 35754, 35956, 36374, 36458, 36888, 37004, 37038, 37438, 37750, 38050, 38490, 38668, 39118, 39308, 39382, 39614, 40528, 40722, 41192, 41816, 42034, 42322, 42494, 42620, 42850, 42936, 42982, 43056, 43898, 44538, 45398, 45434, 45966, 46086, 47618, 49248, 49656, 49864, 52886, 52964, 53446, 55318, 54224, 55308, 55340, 55642, 56126, 56756, 57640, 58035, 58170, 59792, 60452, 61318, 61500, 61706, 62146, 62282, 62618, 64064, 64532, 65606, 65634, 65956, 66502, 68062, 68266, 68338, 68706, 69012, 69300, 69420, 69676, 69812, 70846, 72290, 73046, 73266, 73268, 73540, 73780, 74586, 74702, 75652, 76010, 76290, 76308, 76628, 78850, 78988, 80478, 80666, 81460, 81754, 84534, 86398, 86478, 87066, 88326, 90314, 90656, 91344, 92544, 92828, 93708, 94924, 95688, 95714, 96620, 97704, 97992, 99942, 100350, 100960, 102228, 102288, 104196, 105168, 105712, 106038, 107106, 107212, 107272, 110580, 110962, 128178, 129300, 129486, 135130, 135146, 135208, 150002, 150004, 150006, 150010, 150012, 150014, 150018, 150020, 150022, 150024, 150026, 150028, 150030, 150032, 150034, 150036, 150038, 150040, 150042, 150044, 150046, 150048, 150054, 150056, 150058, 150060, 150062, 150064, 150066, 150068, 150070, 150072, 150076, 150084, 150086, 150088, 150090, 150092, 150094, 150096, 150098, 150100, 150102, 150104, 150106, 150108, 150112, 150114, 150116, 150120, 150122, 150124, 150126, 150130, and 150132, which correspond to SEQ ID NOs: 2 to 568 provided in the Sequence Listing, and/or SEQ ID NOs: 570-624, and/or SEQ ID NOs: 626-672, and/or SEQ ID NOs: 674-826, or a partial-length polypeptide having substantially the same activity as the full-length polypeptide or to a polypeptide encoded by a DIS$^R$ gene of the invention comprising an open reading frame comprising any one of *SEQ ID NOs:8539, 10047, 22073, 22945, 30015, 30017, 30019, 31553, 43055, 45397, 58035, 69037, 73647, 77041, 89655, 97491, 135197, 150007, 150015, 150041, 150051, 150069, 150073, 150077, 150079, 150081, 150091, 150109, 150117, 150127, and 150133; *SEQ ID NOs:3435, 4751, 5005, 6463, 7231, 8225, 8375, 9485, 10449, 10699, 17487, 17651, 18455, 19445, 19621, 21089, 22025, 22441, 22639, 24935, 25429, 26009, 26413, 26615, 27105, 27721, 28507, 28787, 28955, 30013, 30321, 32247, 32847, 33233, 33277, 34579, 35553, 35753, 35955, 36373, 36457, 36887, 38049, 38489, 38667, 39117, 39381, 39613, 42321, 42493, 42619, 42849, 42935, 43055, 43897, 44537, 45397, 45965, 49247, 49655, 49863, 52963, 53445, 54223, 55307, 55339, 56755, 58169, 60451, 61317, 61499, 61705, 62145, 62281, 64531, 65605, 65633, 68061, 68705, 69011, 69299, 69419, 69811, 70845, 72289, 73265, 73267, 73539, 73779, 74585, 74701, 75651, 76009, 76289, 76307, 76627, 78987, 80477, 80665, 84533, 86397, 87065, 88325, 90313, 90655, 91343, 92283, 93707, 95713, 96619, 97703, 97991, 100349, 101633, 103295, 105619, 105749, 106005, 106919, 107381, 109507, and 110823; and/or *SEQ ID NOs:3435, 4515, 4751, 4805, 5005, 6463, 7231, 8225, 8375, 8557, 9485, 9489, 10449, 10699, 14893, 17487, 17651, 18419, 18455, 18571, 18721, 19445, 19483, 19621, 21029, 21089, 21745, 22025, 22441, 22639, 24649, 24935, 25429, 25787, 26009, 26413, 26615, 27105, 27353, 27563, 27721, 27917, 28507, 28787, 28955, 29355, 29371, 30013, 30321, 31409, 31419, 32247, 32847, 33233, 33247, 33277, 34477, 34579, 34585, 35553, 35753, 35955, 36373, 36457, 36887, 37003, 37037, 37437, 37749, 38049, 38489, 38667, 39117, 39307, 39347, 39381, 39613, 40527, 40721, 41191, 41815, 42033, 42321, 42493, 42619, 42849, 42935, 42981, 43055, 43897, 44537, 45397, 45433, 45965, 46085, 47617, 49247, 49655, 49863, 52885, 52963, 53445, 54223, 55307, 55317, 55339, 55641, 56125, 56755, 57639, 58035, 58169, 59791, 60451, 61317, 61499, 61705, 62145, 62281, 62617, 64063, 64531, 65605, 65633, 65955, 66561, 68061, 68265, 68337, 68705, 69011, 69299, 69419, 69675, 69811, 70845, 72289, 73045, 73265, 73267, 73539, 73779, 74585, 74701, 75651, 76009, 76289, 76307, 76627, 78849, 78987, 80477, 80665, 81459, 81753, 84533, 86397, 86477, 87065, 88325, 90313, 90655, 91343, 92283, 92543, 92927, 93707, 94923, 95687, 95713, 96619, 97703, 97991, 99941, 100349, 100959, 102227, 102287, 104075, 104195, 104479, 105167, 105711, 106037, 107105, 107211, 107271, 110579, 110961, 128177, 129299, 129485, 135129, 135145, 135207, 150001, 150003, 150005, 150009, 150011, 150013, 150017, 150019, 150021, 150023, 150025, 150027, 150029, 150031, 150033, 150035, 150037, 150039, 150041, 150043, 150045, 150047, 150053, 150055, 150057, 150059, 150061, 150063, 150065, 150067, 150069, 150071, 150075, 150083, 150085, 150087, 150089, 150091, 150093, 150095, 150097, 150099, 150101, 150103, 150105, 150107, 150111, 150113, 150115, 150119, 150121, 150123, 150125, 150129, and 150131, which correspond to SEQ ID NOs: 1 to 567 provided in the Sequence Listing, and/or SEQ ID NOs: 569-623, and/or SEQ ID NOs: 625-671, and/or SEQ ID NOs: 673-825, or the complement thereof, or a fragment thereof which encodes a partial-length polypeptide having substantially the same activity as the full-length polypeptide or a fragment useful to prepare a construct or vector to decrease or eliminate expression of the corresponding endogenous gene. For example, these open reading frames may be useful to prepare plants that over- or under-express the encoded product or to prepare knock out plants.

The open reading frames of the invention and the corresponding promoter can be identified by any method. For example, they can be identified by employing an array of nucleic acid samples, e.g., each sample having a plurality of oligonucleotides, and each plurality corresponding to a different plant gene, on a solid substrate, e.g., a DNA chip, and probes corresponding to nucleic acid which is up- or down-regulated in response to pathogen infection in one or more ecotypes or species of plant relative to a control (e.g., a water control, nucleic acid from an uninfected plant or nucleic acid from a mutant plant). Thus, genes that are upregulated or downregulated in response to pathogen infection can be systematically identified.

As described herein, reverse genetics and/or computer-based searching and GeneChip® technology is utilized to identify a plurality of rice genes, the expression of which is altered after pathogen infection. In particular, the oligonucleotide genome array permits a broader, more complete and less biased analysis of gene expression. Using labeled cRNA probes, expression levels are determined by laser scanning and genes generally selected for expression levels that are generally >2 fold over the control. For example, using this approach 297 genes are identified, the expression of which is altered in rice after infection with *Magnaporthe grisea*.

The DIS$^R$ genes of the invention are useful to confer improved resistance to plants to infection with more than one pathogen, e.g., pathogens that include bacteria, fungi, oomycetes and viruses, more preferably bacterial and fungal infection. Further, the DIS$^R$ genes described herein can be used to identify orthologous genes which are also likely useful to enhance resistance of plants to pathogens.

Hence, the isolated nucleic acid molecules of the invention include the orthologs (homologs) of the *Arabidopsis* and rice DIS$^R$ sequences described herein, i.e., the corresponding nucleic acid molecules in organisms other than *Arabidopsis* and rice including, but not limited to, plants other than *Arabidopsis* and rice, preferably cereal plants, e.g., corn, wheat, rye, turfgrass, sorghum, millet, sugarcane, soybean, barley, alfalfa, sunflower, canola, soybean, cotton, peanut, tobacco, or sugarbeet. An orthologous gene is a gene from a different species that encodes a product having the same or similar function, e.g., catalyzing the same reaction as a product encoded by a gene from a reference organism. Databases such GenBank may be employed to identify sequences related to the DIS$^R$ sequences herein, e.g., orthologs in cereal crops such as maize, sunflower or alfalfa. Alternatively, recombinant DNA techniques such as hybridization or PCR may be employed to identify sequences related to the DIS$^R$ sequences. The encoded ortholog products likely have at least 70% sequence identity to each other. Hence, the invention includes an isolated nucleic acid molecule comprising a nucleotide sequence encoding a polypeptide having at least 70% identity to a polypeptide encoded by one or more of the DIS$^R$ sequences disclosed herein. However, an ortholog includes nucleic acid encoding polypeptides having less than 70%, e.g., 65%, amino acid sequence identity or less, but which ortholog encodes a polypeptide having the same or similar function as the reference polypeptide.

The $DIS^R$ genes described hereinabove can be used to identify orthologous genes which may be expressed in a particular tissue and/or development manner. Hence, the isolated nucleic acid molecules of the invention include the orthologs of the $DIS^R$ sequences disclosed herein, i.e., the corresponding nucleotide sequences in organisms other than *Arabidopsis* and rice, including, but not limited to, plants other than *Arabidopsis* and rice, preferably cereal plants, e.g., corn, wheat, rye, turfgrass, sorghum, millet, sugarcane, soybean, barley, alfalfa, sunflower, canola, soybean, cotton, peanut, tobacco, or sugarbeet.

In its broadest sense, the term "substantially similar" when used herein with respect to a nucleotide sequence means that the nucleotide sequence is part of a gene which encodes a polypeptide having substantially the same structure and function as a polypeptide encoded by a gene for the reference nucleotide sequence. The term "substantially similar" thus includes nucleotide sequences wherein the sequence has been modified, for example, to optimize expression in particular cells, as well as nucleotide sequences encoding a variant polypeptide comprising one or more amino acid substitutions relative to the (unmodified) polypeptide encoded by the reference sequence, which substitution(s) does not alter the activity of the variant polypeptide relative to the unmodified polypeptide. In its broadest sense, the term "substantially similar" when used herein with respect to polypeptide means that the polypeptide has substantially the same structure and function as the reference polypeptide. The percentage of amino acid sequence identity between the substantially similar and the reference polypeptide is at least 65%, 66%, 67%, 68%, 69%, 70%, e.g., 71%, 72%, 73%, 74%, 75%, 76%, 77%, 78%, 79%, 80%, 81%, 82%, 83%, 84%, 85%, 86%, 87%, 88%, 89%, and even 90% or more, e.g., 91%, 92%, 93%, 94%, 95%, 96%, 97%, 98%, up to at least 99%, wherein the reference polypeptide is a polypeptide encoded by a gene comprising a $DIS^R$ sequence of the invention, preferably a rice gene or an ortholog of any one of the $DIS^R$ sequences disclosed herein. One indication that two polypeptides are substantially similar to each other, besides having substantially the same function, is that an agent, e.g., an antibody, which specifically binds to one of the polypeptides, specifically binds to the other.

Sequence comparisons maybe carried out using a Smith-Waterman sequence alignment algorithm (see e.g., Waterman (1995)). The localS program, version 1.16, is preferably used with following parameters: match: 1, mismatch penalty: 0.33, open-gap penalty: 2, extended-gap penalty: 2. Further, a nucleotide sequence that is "substantially similar" to a reference nucleotide sequence hybridizes to the reference nucleotide sequence in 7% sodium dodecyl sulfate (SDS), 0.5 M $NaPO_4$, 1 mM EDTA at 50° C. with washing in 2×SSC, 0.1% SDS at 50° C., more desirably in 7% sodium dodecyl sulfate (SDS), 0.5 M $NaPO_4$, 1 mM EDTA at 50° C. with washing in 1×SSC, 0.1% SDS at 50° C., more desirably still in 7% sodium dodecyl sulfate (SDS), 0.5 M $NaPO_4$, 1 mM EDTA at 50° C. with washing in 0.5×SSC, 0.1% SDS at 50° C., preferably in 7% sodium dodecyl sulfate (SDS), 0.5 M $NaPO_4$, 1 mM EDTA at 50° C. with washing in 0.1×SSC, 0.1% SDS at 50° C., more preferably in 7% sodium dodecyl sulfate (SDS), 0.5 M $NaPO_4$, 1 mM EDTA at 50° C. with washing in 0.1× SSC, 0.1% SDS at 65° C.

Hence, the present invention further provides a construct, expression cassette or vector containing the nucleic acid molecule comprising an open reading frame of the invention operably linked to a promoter, and the vector may be a plasmid. Such constructs, cassettes or vectors, when present in a plant, plant cell or plant tissue result in transcription of the linked nucleic acid molecule in the plant. The constructs, expression cassettes or vectors of the invention may optionally include other regulatory sequences, e.g., transcription terminator sequences, operator, repressor binding site, transcription factor binding site, and/or an enhancer and may be contained in a host cell. The construct, expression cassette or vector may augment the genome of a transformed plant or may be maintained extrachromosomally. The construct, expression cassette or vector may further have a Ti plasmid and be contained in an *Agrobacterium tumefaciens* cell; it may be carried on a microparticle, wherein the microparticle is suitable for ballistic transformation of a plant cell; or it may be contained in a plant cell or protoplast. Further, the construct, expression cassette can be contained in a transformed plant or cells thereof and the plant may be a dicot or a monocot. In particular, the plant may be a cereal plant.

The invention also provides sense and antisense nucleic acid molecules corresponding to the open reading frames identified herein as well as their orthologs. Also provided are constructs, expression cassettes, e.g., recombinant vectors, and host cells, comprising the nucleic acid molecule of the invention, e.g., one which comprises a nucleotide sequence which encodes a polypeptide the expression of which is altered in response to pathogen infection.

The present invention further provides a method of augmenting a plant genome by contacting plant cells with a nucleic acid molecule of the invention, e.g., one isolatable or obtained from a plant gene encoding a polypeptide that is substantially similar to a $DIS^R$ polypeptide described herein so as to yield transformed plant cells; and regenerating the transformed plant cells to provide a differentiated transformed plant, wherein the differentiated transformed plant expresses the nucleic acid molecule in the cells of the plant. The nucleic acid molecule may be present in the nucleus, chloroplast, mitochondria and/or plastid of the cells of the plant. The present invention also provides a transgenic plant prepared by this method, a seed from such a plant and progeny plants from such a plant including hybrids and inbreds. Preferred transgenic plants are transgenic maize, soybean, barley, alfalfa, sunflower, canola, soybean, cotton, peanut, sorghum, tobacco, sugarbeet, rice, wheat, rye, turfgrass, millet, sugarcane, tomato, or potato.

The invention also provides a method of plant breeding, e.g., to prepare a crossed fertile transgenic plant. The method comprises crossing a fertile transgenic plant comprising a particular nucleic acid molecule of the invention with itself or with a second plant, e.g., one lacking the particular nucleic acid molecule, to prepare the seed of a crossed fertile transgenic plant comprising the particular nucleic acid molecule. The seed is then planted to obtain a crossed fertile transgenic plant. The plant may be a monocot or a dicot. In a particular embodiment, the plant is a cereal plant.

The crossed fertile transgenic plant may have the particular nucleic acid molecule inherited through a female parent or through a male parent. The second plant may be an inbred plant. The crossed fertile transgenic may be a hybrid. Also included within the present invention are seeds of any of these crossed fertile transgenic plants.

The various breeding steps are characterized by well-defined human intervention such as selecting the lines to be crossed, directing pollination of the parental lines, or selecting appropriate progeny plants. Depending on the desired properties different breeding measures are taken. The relevant techniques are well known in the art and include but are not limited to hybridization, inbreeding, backcross breeding, multiline breeding, variety blend, interspecific hybridization, aneuploid techniques, and the like. Hybridization techniques also include the sterilization of plants to yield male or female sterile plants by mechanical, chemical or biochemical means. Cross pollination of a male sterile plant with pollen of a different line assures that the genome of the male sterile but female fertile plant will uniformly obtain properties of both parental lines. Thus, the transgenic plants according to the invention can be used for the breeding of improved plant lines that for example increase the effectiveness of conventional methods such as herbicide or pesticide treatment or allow to dispense with said methods due to their modified genetic properties. Alternatively new crops with improved stress tolerance can be obtained that, due to their optimized genetic "equipment", yield harvested product of better quality than products that are not able to tolerate comparable adverse developmental conditions.

The nucleic acid molecules of the invention, their encoded polypeptides and compositions thereof, are useful to provide resistance to pathogens, to alter expression of a particular gene corresponding to the open reading frame by overexpressing a $DIS^R$ gene product, and as a diagnostic for the presence or absence of the pathogen by correlating the expression level or pattern of expression of one or more of the nucleic acid molecules or polypeptides of the invention. As one embodiment of the invention includes isolated nucleic acid molecules that have increased expression in response to pathogen infection, the invention further provides compositions and methods for enhancing resistance to pathogen infection. The compositions of the invention include plant nucleic acid sequences and the amino acid sequences for the polypeptides or partial-length polypeptides encoded thereby which are described herein, or other plant nucleic acid sequences and the amino acid sequences for the polypeptides or partial-length polypeptides encoded thereby which are operably linked to a promoter are useful to provide tolerance or resistance to a plant to a pathogen, preferably by preventing or inhibiting pathogen infection. Methods of the invention involve stably transforming a plant with one or more of at least a portion of these nucleotide sequences which confer tolerance or resistance operably linked to a promoter capable of driving expression of that nucleotide sequence in a plant cell. By "portion" or "fragment", as it relates to a nucleic acid molecule, sequence or segment of the invention, when it is linked to other sequences for expression, is meant a sequence comprising at least 80 nucleotides, more preferably at least 150 nucleotides, and still more preferably at least 400 nucleotides. If not employed for expressing, a "portion" or "fragment" means at least 9, preferably 12, more preferably 15, even more preferably at least 20, consecutive nucleotides, e.g., probes and primers (oligonucleotides), corresponding to the nucleotide sequence of the nucleic acid molecules of the invention. By "resistant" is meant a plant which exhibits substantially no phenotypic changes as a consequence of infection with the pathogen. By "tolerant" is meant a plant which, although it may exhibit some phenotypic changes as a consequence of infection, does not have a substantially decreased reproductive capacity or substantially altered metabolism.

A method of combating a pathogen in an agricultural crop is also provided. The method comprises introducing to a plant, plant cell, or plant tissue an expression cassette comprising a $DIS^R$ nucleic acid molecule of the invention comprising an open reading frame so as to yield a transformed differentiated plant, transformed cell or transformed tissue. Transformed cells or tissue can be regenerated to provide a transformed differentiated plant. The transformed differentiated plant preferably expresses the nucleic acid molecule in an amount that confers resistance to the transformed plant to pathogen infection relative to a corresponding nontransformed plant. The present invention also provides a transformed plant prepared by the method, progeny and seed thereof. Examples of plant viruses which may be combated by the present invention include single stranded RNA viruses (with and without envelope), double stranded RNA viruses, and single and double stranded DNA viruses such as (but not limited to) tobacco mosaic virus, cucumber mosaic virus, turnip mosaic virus, turnip vein clearing virus, oilseed rape mosaic virus, tobacco rattle virus, pea enation mosaic virus, barley stripe mosaic virus, potato viruses X and Y, carnation latent virus, beet yellows virus, maize chlorotic virus, tobacco necrosis virus, turnip yellow mosaic virus, tomato bushy stunt virus, southern bean mosaic virus, barley yellow dwarf virus, tomato spotted wilt virus, lettuce necrotic yellows virus, wound tumor virus, maize steak virus, and cauliflower mosaic virus. Other pathogens within the scope of the invention include, but are not limited to, fungi such as *Cochliobolus carbonum*, *Phytophthora infestans*, *Phytophthora sojae*, *Collesosichum*, *Melampsora lini*, *cladosporium fulvum*, *Heminthosporium maydia*, *Peronospora parasitica*, *Puccinia sorghi*, and *Puccinia polysora*; bacteria such as *Phynchosporium secalis*, *Pseudomonas glycinea*, *Xanthomonas oryzae* and, *Fusarium oxyaporium*; and nematodes such as *Globodera rostochiensis*.

To provide resistance or tolerance to a pathogen in a plant, a $DIS^R$ sequence may be overexpressed individually, in the sense or antisense orientation, or in combination with other sequences to confer improved disease resistance or tolerance to a plant relative to a plant that does not comprise and/or express the sequence, or does not do so at a level that provides increased tolerance, or does not express the sequence in the desired tissue(s) at a level that provides increased tolerance. The overexpression may be constitutive, or it may be preferable to express the effector gene(s) in a tissue-specific manner or from an inducible promoter including a promoter which is responsive to external stimuli, such as chemical application, or to pathogen infection, e.g., so as to avoid possible deleterious effects on plant growth if the effector gene(s) is constitutively expressed. In one embodiment of the invention, the promoter employed may be one that is rapidly and transiently and/or highly transcribed after pathogen infection.

A transformed (transgenic) plant of the invention includes plants, for example, a plant the cells of which have an expression cassette of the invention, i.e., an expression cassette having a polynucleotide of the invention operatively linked to an open reading frame, or, the genome of which is augmented by a nucleic acid molecule of the invention, or in which the corresponding gene has been disrupted, e.g., to result in a loss, a decrease or an alteration, in the function of the product encoded by the gene, which plant may also have increased yields, e.g., under conditions of pathogen infection, and/or produce a better-quality product than the corresponding wild-type plant. The nucleic acid molecules of the invention are thus useful for targeted gene disruption, as well as markers and probes.

For example, the invention includes a pathogen, e.g., bacteria or fungi, tolerant or resistant plant and seed thereof having stably integrated and expressed within its genome, a $DIS^R$ nucleic acid molecule of the invention. The normal fertile transformed (transgenic) plant may be selfed to yield a substantially homogenous line with respect to viral resistance or tolerance. Individuals of the line, or the progeny thereof, may be crossed with plants which optionally exhibit the trait. In a particular embodiment of the method, the selfing and selection steps are repeated at least five times in order to obtain the homogenous (isogenic) line. Thus, the invention also provides transgenic plants and the products of the transgenic plants.

The invention further includes a nucleotide sequence which is complementary to one (hereinafter "test" sequence) which hybridizes under low, moderate or stringent conditions with the DIS nucleic acid molecules of the invention as well as RNA which is encoded by the nucleic acid molecule. When the hybridization is performed under stringent conditions, either the test or nucleic acid molecule of invention is preferably supported, e.g., on a membrane or DNA chip. Thus, either a denatured test or nucleic acid molecule of the invention is preferably first bound to a support and hybridization is effected for a specified period of time at a temperature of, e.g., between 55 and 70° C., in double strength citrate buffered saline (SC) containing 0.1% SDS followed by rinsing of the support at the same temperature but with a buffer having a reduced SC concentration. Depending upon the degree of stringency required such reduced concentration buffers are typically single strength SC containing 0.1% SDS, half strength SC containing 0.1% SDS and one-tenth strength SC containing 0.1% SDS.

The invention further provides a method for identifying a plant cell infected with a pathogen. The method comprises contacting nucleic acid obtained from a plant cell suspected of being infected with a pathogen with oligonucleotides corresponding to a portion of a plurality of sequences selected from $DIS^R$ sequences disclosed herein under conditions effective to amplify those sequences. Then the presence of the amplified product is detected or determined. The presence of a amplified $DIS^R$ product, e.g., in an amount that is different than the amount of the corresponding amplified products from an uninfected plant, is indicative of pathogen infection.

The invention further provides a method for identifying a plant cell infected with a pathogen. The method comprises contacting a protein sample obtained from a plant cell suspected of being infected with a pathogen with an agent that specifically binds a polypeptide encoded by an open reading frame comprising a $DIS^R$ sequence so as to form a complex. Then the presence or amount of complex formation is detected or determined.

The invention provides an additional method for identifying a plant cell infected with a pathogen. The method comprises hybridizing a probe selected from a $DIS^R$ sequence to nucleic acid obtained from a plant cell suspected of being infected with a pathogen. The amount of the probe hybridized to nucleic acid obtained from a cell suspected of being infected with a virus is compared to hybridization of the probe to nucleic acid isolated from an uninfected cell. A change in the amount of at least two probes that hybridize to nucleic acid isolated from a cell suspected of being infected by a virus relative to hybridization of at least two probes to nucleic acid isolated from an uninfected cell is indicative of viral infection.

A method to shuffle the nucleic acids of the invention is provided. This method involves fragmentation of a nucleic acid corresponding to a $DIS^R$ sequence described herein, the orthologs thereof, and the corresponding genes, followed by religation. This method allows for the production of polypeptides having altered activity relative to the native form of the polypeptide. Accordingly, the invention provides cells and transgenic plants containing nucleic acid segments produced through shuffling that encode polypeptides having altered activity relative to the corresponding native polypeptide.

A computer readable medium, e.g., a magnetic tape, optical disk, CD-ROM, random access memory, volatile memory, non-volatile memory, or bubble memory, containing the nucleic acid sequences of the invention as well as methods of use for the computer readable medium are provided. For example, a computer readable medium can contain a nucleic acid molecule that has at least 70% nucleic acid sequence identity to a $DIS^R$ sequence or the complement thereof. This medium allows a nucleic acid segment corresponding to a $DIS^R$ nucleic acid sequence disclosed herein to be used as a reference sequence to search against databases. This medium also allows for computer-based manipulation of a nucleic acid sequence corresponding to a $DIS^R$ nucleic acid, and the corresponding gene and polypeptide encoded by the nucleic acid sequence.

The invention also provides a method for marker-assisted breeding to select for plants having altered resistance to a pathogen. The method involves contacting plant DNA or cDNA with a probe corresponding to a DISK nucleic acid sequence, the orthologs thereof, and the corresponding genes, or a portion thereof which hybridizes under moderate stringency conditions to a gene corresponding to one of the $DIS^R$ sequences described herein so as to form a duplex and detecting or determining the presence or amount of the duplex. The amount or presence of the duplex is indicative of the presence of a gene, the expression of which alters the resistance of the plant to a pathogen.

Therefore, another embodiment of the present invention provides a method of using known inducers or inhibitors of genes identified as being important in plant-pathogen interactions to induce genes that are important in resistance, or to inhibit genes that are downregulated in resistance.

Thus, some of the isolated nucleic acid molecules of the invention are useful in a method of combating a pathogen in an agricultural crop. The method comprises introducing to a plant an expression cassette comprising a nucleic acid molecule of the invention so as to yield a transformed differentiated plant. The transformed differentiated plant expresses the nucleic acid molecule in an amount that confers resistance to the transformed plant to infection relative to a corresponding nontransformed plant.

BRIEF DESCRIPTION OF THE SEQUENCES IN THE SEQUENCE LISTING

Odd numbered SEQ ID NOs:1-623 are representing a first sub-group (sub-group I) of polynucleotides comprising nucleotide sequences that encode polypeptides related to disease resistance ($DIS^R$).

Even numbered SEQ ID NOs:2-624 are protein or polypeptide sequences encoded by the immediately preceding nucleotide sequence, e.g., SEQ ID NO:2 is the protein encoded by the nucleotide sequence of SEQ ID NO:1, SEQ ID NO:4 is the protein encoded by the nucleotide sequence of SEQ ID NO:3, etc.

Odd numbered SEQ ID NOs: 625-671 are representing a second sub-group (sub-group II) of polynucleotides comprising rice cDNA sequences. The correlation between the sequences in sub-groups I and II is illustrated in Table 7.

Even numbered SEQ ID NOs:626-672 are protein sequences encoded by the immediately preceding nucleotide sequence.

Odd numbered SEQ ID NOs: 673-825 are representing a third sub-group (sub-group III) of polynucleotides comprising nucleotide sequences that have homologies between 80% and 99.9% to the nucleotide sequences of sub-group one and are possible variants or family members of rice sequences provided in SEQ ID NOs: 1-624. The correlation between the sequences in sub-groups I and III is illustrated in Table 8

Even numbered SEQ ID NOs:674-826 are protein sequences encoded by the immediately preceding nucleotide sequence.

SEQ ID NOs: 827-971 are banana sequences which show homology to rice "DIS$^R$" genes.

SEQ ID NOs: 972-1207 are wheat sequences which show homology to rice "DIS$^R$" genes.

SEQ ID NOs: 1208-1386 are maize sequences which show homology to rice "DIS$^R$" genes.

SEQ ID NOs: 1387 and 1389 are nucleotide sequences encoding a rice oxalate oxidase.

SEQ ID NOs: 1388 and 1390 are polypeptides that exhibit a rice oxalate oxidase activity and are encoded by SEQ ID NOs: 827 and 829, respectively.

SEQ ID NOs: 1391 and 1394 are primer sequences.

I. DEFINITIONS

The term "gene" is used broadly to refer to any segment of nucleic acid associated with a biological function. Thus, genes include coding sequences and/or the regulatory sequences required for their expression. For example, gene refers to a nucleic acid fragment that expresses mRNA or functional RNA, or encodes a specific protein, and which includes regulatory sequences. Genes also include nonexpressed DNA segments that, for example, form recognition sequences for other proteins. Genes can be obtained from a variety of sources, including cloning from a source of interest or synthesizing from known or predicted sequence information, and may include sequences designed to have desired parameters.

The term "native" or "wild type" gene refers to a gene that is present in the genome of an untransformed cell, i.e., a cell not having a known mutation.

A "marker gene" encodes a selectable or screenable trait.

The term "chimeric gene" refers to any gene that contains 1) DNA sequences, including regulatory and coding sequences, that are not found together in nature, or 2) sequences encoding parts of proteins not naturally adjoined, or 3) parts of promoters that are not naturally adjoined. Accordingly, a chimeric gene may comprise regulatory sequences and coding sequences that are derived from different sources, or comprise regulatory sequences and coding sequences derived from the same source, but arranged in a manner different from that found in nature.

A "transgene" refers to a gene that has been introduced into the genome by transformation and is stably maintained. Transgenes may include, for example, genes that are either heterologous or homologous to the genes of a particular plant to be transformed. Additionally, transgenes may comprise native genes inserted into a non-native organism, or chimeric genes. The term "endogenous gene" refers to a native gene in its natural location in the genome of an organism. A "foreign" gene refers to a gene not normally found in the host organism but that is introduced by gene transfer.

An "oligonucleotide" corresponding to a nucleotide sequence of the invention, e.g., for use in probing or amplification reactions, may be about 30 or fewer nucleotides in length (e.g., 9, 12, 15, 18, 20, 21 or 24, or any number between 9 and 30). Generally specific primers are upwards of 14 nucleotides in length. For optimum specificity and cost effectiveness, primers of 16 to 24 nucleotides in length may be preferred. Those skilled in the art are well versed in the design of primers for use processes such as PCR. If required, probing can be done with entire restriction fragments of the gene disclosed herein which may be 100's or even 1000's of nucleotides in length.

The terms "protein," "peptide" and "polypeptide" are used interchangeably herein.

The nucleotide sequences of the invention can be introduced into any plant. The genes to be introduced can be conveniently used in expression cassettes for introduction and expression in any plant of interest. Such expression cassettes will comprise the transcriptional initiation region of the invention linked to a nucleotide sequence of interest. Preferred promoters include constitutive, tissue-specific, developmental-specific, inducible and/or viral promoters. Such an expression cassette is provided with a plurality of restriction sites for insertion of the gene of interest to be under the transcriptional regulation of the regulatory regions. The expression cassette may additionally contain selectable marker genes. The cassette will include in the 5'-3' direction of transcription, a transcriptional and translational initiation region, a DNA sequence of interest, and a transcriptional and translational termination region functional in plants. The termination region may be native with the transcriptional initiation region, may be native with the DNA sequence of interest, or may be derived from another source. Convenient termination regions are available from the Ti-plasmid of *A. tumefaciens*, such as the octopine synthase and nopaline synthase termination regions. See also, Guerineau et al., 1991; Proudfoot, 1991; Sanfacon et al., 1991; Mogen et al., 1990; Munroe et al., 1990; Ballas et al., 1989; Joshi et al., 1987.

"Coding sequence" refers to a DNA or RNA sequence that codes for a specific amino acid sequence and excludes the non-coding sequences. It may constitute an "uninterrupted coding sequence", i.e., lacking an intron, such as in a cDNA or it may include one or more introns bounded by appropriate splice junctions. An "intron" is a sequence of RNA which is contained in the primary transcript but which is removed through cleavage and re-ligation of the RNA within the cell to create the mature mRNA that can be translated into a protein.

The terms "open reading frame" and "ORF" refer to the amino acid sequence encoded between translation initiation and termination codons of a coding sequence. The terms "initiation codon" and "termination codon" refer to a unit of three adjacent nucleotides ('codon') in a coding sequence that specifies initiation and chain termination, respectively, of protein synthesis (mRNA translation).

A "functional RNA" refers to an antisense RNA, ribozyme, or other RNA that is not translated.

The term "RNA transcript" refers to the product resulting from RNA polymerase catalyzed transcription of a DNA sequence. When the RNA transcript is a perfect complementary copy of the DNA sequence, it is referred to as the primary transcript or it may be a RNA sequence derived from post-transcriptional processing of the primary transcript and is referred to as the mature RNA. "Messenger RNA" (mRNA) refers to the RNA that is without introns and that can be translated into protein by the cell. "cDNA" refers to a single- or a double-stranded DNA that is complementary to and derived from mRNA.

"Regulatory sequences" and "suitable regulatory sequences" each refer to nucleotide sequences located upstream (5' non-coding sequences), within, or downstream (3' non-coding sequences) of a coding sequence, and which influence the transcription, RNA processing or stability, or translation of the associated coding sequence. Regulatory sequences include enhancers, promoters, translation leader sequences, introns, and polyadenylation signal sequences. They include natural and synthetic sequences as well as sequences which may be a combination of synthetic and natural sequences. As is noted above, the term "suitable regulatory sequences" is not limited to promoters.

"5' non-coding sequence" refers to a nucleotide sequence located 5' (upstream) to the coding sequence. It is present in the fully processed mRNA upstream of the initiation codon and may affect processing of the primary transcript to mRNA, mRNA stability or translation efficiency (Turner et al., 1995).

"3' non-coding sequence" refers to nucleotide sequences located 3' (downstream) to a coding sequence and include polyadenylation signal sequences and other sequences encoding regulatory signals capable of affecting mRNA processing or gene expression. The polyadenylation signal is usually characterized by affecting the addition of polyadenylic acid tracts to the 3' end of the mRNA precursor. The use of different 3' non-coding sequences is exemplified by Ingelbrecht et al., 1989.

The term "translation leader sequence" refers to that DNA sequence portion of a gene between the promoter and coding sequence that is transcribed into RNA and is present in the fully processed mRNA upstream (5') of the translation start codon. The translation leader sequence may affect processing of the primary transcript to mRNA, mRNA stability or translation efficiency.

The term "mature" protein refers to a post-translationally processed polypeptide without its signal peptide. "Precursor" protein refers to the primary product of translation of an mRNA. "Signal peptide" refers to the amino terminal extension of a polypeptide, which is translated in conjunction with the polypeptide forming a precursor peptide and which is required for its entrance into the secretory pathway. The term "signal sequence" refers to a nucleotide sequence that encodes the signal peptide.

The term "intracellular localization sequence" refers to a nucleotide sequence that encodes an intracellular targeting signal. An "intracellular targeting signal" is an amino acid sequence that is translated in conjunction with a protein and directs it to a particular sub-cellular compartment "Endoplasmic reticulum (ER) stop transit signal" refers to a carboxyterminal extension of a polypeptide, which is translated in conjunction with the polypeptide and causes a protein that enters the secretory pathway to be retained in the ER. "ER stop transit sequence" refers to a nucleotide sequence that encodes the ER targeting signal. Other intracellular targeting sequences encode targeting signals active in seeds and/or leaves and vacuolar targeting signals.

"Pathogen" as used herein includes but is not limited to bacteria, fungi, yeast, oomycetes and virus, e.g., American wheat striate mosaic virus mosaic (AWSMV), barley stripe mosaic virus (BSMV), barley yellow dwarf virus (BYDV), Brome mosaic virus (BMV), cereal chlorotic mottle virus (CCMV), corn chlorotic vein banding virus (CCVBV), maize chlorotic mottle virus (MCMV), maize dwarf mosaic virus (MDMV), A or B, wheat streak mosaic virus (WSMV), cucumber mosaic virus (CMV), cynodon chlorotic streak virus (CCSV), Johnsongrass mosaic virus (JGMV), maize bushy stunt or mycoplasma-like organism (NILO), maize chlorotic dwarf virus (MCDV), maize chlorotic mottle virus (MCMV), maize dwarf mosaic virus (MDMV) strains A, D, E and F, maize leaf fleck virus (MLFV), maize line virus (NELV), maize mosaic virus (MMV), maize mottle and chlorotic stunt virus, maize pellucid ringspot virus (MPRV), maize raya gruesa virus (MRGV), maize rayado fino virus (MRFV), maize red leaf and red stripe virus (MRSV), maize ring mottle virus (MRMV), maize rio cuarto virus (MRCV), maize rough dwarf virus (MRDV), maize sterile stunt virus (strains of barley yellow striate virus), maize streak virus (MSV), maize chlorotic stripe, maize hoja Maize stripe virus blanca, maize stunting virus, maize tassel abortion virus (MTAV), maize vein enation virus (MVEV), maize wallaby ear virus (MAVEV), maize white leaf virus, maize white line mosaic virus (NTVVLMV), millet red leaf virus (NMV), Northern cereal mosaic virus (NCMV), oat pseudorosette virus, oat sterile dwarf virus (OSDV), rice black-streaked dwarf virus (RBSDV), rice stripe virus (RSV), sorghum mosaic virus (SrMV), formerly sugarcane mosaic virus (SCMV) stains H, I and M, sugarcane Fiji disease virus (FDV), sugarcane mosaic virus (SCMV) strains A, B, D, E, SC, BC, Sabi and NM vein enation virus, and wheat spot mosaic virus (WSMV).

Bacterial pathogens include but are not limited to *Pseudomonas avenae* subsp. *avenae*, *Xanthomonas campestris* pv. *holcicola*, *Enterobacter dissolvens*, *Erwinia dissolvens*, *Ervinia carotovora* subsp. *carotovora*, *Erwinia chrysanthemi* pv. *zeae*, *Pseudomonas andropogonis*, *Pseudomonas syringae* pv. *coronafaciens*, *Clavibacter michiganensis* subsp., *Corynebacterium michiganense* pv. *nebraskense*, *Pseudomonas syringae* pv. *syringae*, Herniparasitic bacteria (see under fungi), *Bacillus subtilis*, *Erwinia stewartii*, and *Spiroplasma kunkelii*.

Fungal pathogens include but are not limited to *Collelotrichum graminicola*, *Glomerella graminicola* Politis, *Glomerella lucumanensis*, *Aspergillus flavus*, *Rhizoctonia solani* Kuhn, *Thanatephorus cucumeris*, *Acremonium strictum* W. Gams, *Cephalosporium acremonium* Auct. non Corda Black *Lasiodiplodia theobromae*=BoIr odiplodia y theobromae Borde blanco *Marasmiellus* sp., *Physoderma maydis*, *Cephalosporium Corticium sasakii*, *Curvularia clavata*, *C. maculans*, *Cochhobolus eragrostidis*, *Curvularia inaequahs*, *C. intermedia* (teleomorph *Cochhobolus intermedius*), *Curvularia lunata* (teleomorph: *Cochliobolus lunatus*), *Curvularia pallescens* (teleomorph—*Cochliobolus pallescens*), *Curvularia senegalensis*, *C. luberculata* (teleomorph: *Cochliobolus tuberculatus*), *Didymella exitalis Diplodiaftumenti* (teleomorph—*Botryosphaeriafestucae*), *Diplodia maydis*=*Stenocarpella maydis*, *Stenocarpella macrospora*=*Diplodia macrospora*, *Sclerophthora rayssiae* var. *zeae*, *Sclerophthora macrospora*=*Sclerospora macrospora*, *Sclerospora graminicola*, *Peronosclerospora maydis*=*Sclerospora maydis*, *Peronosclerospora philippinensis*, *Sclerospora philippinensis*, *Peronosclerospora sorghi*=*Sclerospora sorghi*, *Peronosclerospora spontanea*=*Sclerospora spontanea*, *Peronosclerospora sacchari*=*Sclerospora sacchari*, *Nigrospora oryzae* (teleomorph: *Khuskia oryzae*) *A. Iternaria alternala*=*A. tenuis*, *Aspergillus glaucus*, *A. niger*, *Aspergillus* spp., *Botrytis cinerea*, *Cunninghamella* sp., *Curvulariapallescens*, *Doratomyces slemonitis*=*Cephalotrichum slemonitis*, *Fusarium culmorum*, *Gonatobotrys* simplex, *Pithomyces maydicus*, *Rhizopus microsporus* Tiegh., *R. stolonifer*=*R. nigricans*, *Scopulariopsis brumptii*, *Claviceps gigantea* (anamorph: *Sphacelia* sp.) *Aureobasidium zeae*=*Kabatiella zeae*, *Fusariumn subglutinans*=*F. moniliforme* var. *subglutinans*, *Fusarium moniliforme*, *Fusarium avenaceum* (teleomorph—*Gibberella avenacea*), *Botryosphaeria zeae*=*Physalospora zeae* (anamorph: *Allacrophoma zeae*), *Cercospora sorghi*=*C. sorghi* var. *maydis*, *Helminthosporium pedicellatum* (teleomorph: *Selosphaeriapedicellata*), *Cladosporium cladosporioides*=*Hormodendrum cladosporioides*, *C. herbarum* (teleomorph—*Mycosphaerella tassiana*), *Cephalosporium maydis*, *A. Iternaria alternata*, *A. scochyta maydis*, *A. tritici*, *A. zeicola*, *Bipolaris victoriae*, *Helminthosporium victoriae* (teleomorph *Cochhoholus victoriae*), *C. sativus* (anamorph: *Bipolaris sorokiniana*=*H. sorokinianum*=*H. sativum*), *Epicoccum nigrum*, *Exserohilum prolatum*=*Drechslera prolata* (teleomorph: *Setosphaeriaprolata*), *Graphium penicillioides*, *Leptosphaeria maydis*,

*Leptothyrium zeae, Ophiosphaerella herpotricha* (anamorph—*Scolecosporiella* sp.), *Pataphaeosphaeria michotii, Phoma* sp., *Septoria zeae, S. zeicola, S. zeina Setosphaeria turcica, Exserohilzim turcicum=Helminthosporium furcicum, Cochhoholus carbonum, Bipolaris zeicola=Helminthosporium carhonum, Penicilhum* spp., *P. chrysogenum, P. expansum, P. oxalicum, Phaeocytostroma ambiguum, Phaeocylosporella zeae, Phaeosphaeria maydis=Sphaerulina nmaydis, Botryosphaeriafestucae=Physalospora zeicola* (anamorph: *Diplodiaftumenfi*), Herniparasitic bacteria and fungi *Pyrenochaeta Phoma terrestris=Pyrenochaeta terrestris, Pythiumn* spp., *P. arrhenomanes, P. graminicola, Pythium aphanidermatum=P. hutleri* L., *Rhizoctonia zeae* (teleomorph: *Waitea circinata*), *Rhizoctonia solani, minor A Iternaria alternala, Cercospora sorghi, Dictochaetafirtilis, Fusarium acuminatum* (teleomorph *Gihherella acuminata*), *E. equiseti* (teleomorph: *G. intricans*), *E. oxysporum, E. pallidoroseum, E. poae, E. roseum, G. cyanogena* (anamorph: *E. sulphureum*), *Microdochium holleyi, Mucor* sp., *Periconia circinata, Phytophthora cactorum, P. drechsleri, P. nicotianae* var. *parasitica, Rhizopus arrhizus, Setosphaeria rostrata, Exserohilum rostratum=Helminthosporium rostratum, Puccinia sorghi, Physopella pallescens, P. zeae, Sclerotium rofsii Sacc.* (teleomorph—*Athelia rotfsii*), *Bipolaris sorokiniana, B. zeicola=Helminthosporium carbonum, Diplodia maydis, Exserohilum pedicillatum, Exserohilum furcicum=Helminthosporium turcicum, Fusarium avenaceum, E. culmorum, E. moniliforme, Gibberella zeae* (anamorph—*E. graminearum*), *Macrophominaphaseolina, Penicillium* spp., *Phomopsis* sp., *Pythium* spp., *Rhizoctonia solani, R. zeae, Sclerotium rolfsfi, Spicaria* sp., *Selenophoma* sp., *Gaeumannomyces graminis, Myrothecium gramineum, Monascus purpureus, M. ruber Smut, Ustilago zeae=U. maydis Smut, Ustilaginoidea virens Smut, Sphacelotheca reiliana=Sporisorium holci, Cochliobolus heterostrophus* (anamorph: *Bipolaris maydis=Helminthosporium maydis*), *Stenocarpella macrospora=Diplodia macrospora, Cercospora sorghi, Fusarium episphaeria, E. merismoides, F. oxysporum Schlechtend, E. poae, E. roseum, E. solani* (teleomorph: *Nectria haematococca*), *F. tricincturn, Mariannaea elegans, Mucor* sp., *Rhopographus zeae, Spicaria* sp., *Aspergillus* spp., *Penicillium* spp., *Trichoderma viride=T. lignorum* teleomorph: *Hypocrea* sp., *Stenocarpella maydis=Diplodia zeae, Ascochyta ischaemi, Phyllosticta maydis* (telomorph: *Mycosphaerella zeae-maydis*), and *Gloeocercospora sorghi.*

Parasitic nematodes include but are not limited to Awl *Dolichodorus* spp., *D. heterocephalus* Bulb and stem (Europe), *Ditylenchus dipsaci* Burrowing *Radopholus similis* Cyst *Heterodera avenae, H. zeae, Punctodera chalcoensis* Dagger *Xiphinema* spp., *X. americanum, X. mediterraneum* False root-knot *Nacobbus dorsalis* Lance, Columbia *Hoplolaimus columbus* Lance *Hoplolaimus* spp., *H. galeatus* Lesion *Pratylenchus* spp., *P. brachyurus, P. crenalus, P. hexincisus, P. neglectus, P. penetrans, P. scribneri, P. thornei, P. zeae* Needle *Longidorus* spp., *L. breviannulatus* Ring *Criconemella* spp., *C ornata* Root-knot *Meloidogyne* spp., *M. chitwoodi, M. incognita, M. javanica* Spiral *Helicotylenchus* spp., *Belonolaimus* spp., *B. longicaudatus* Stubby-root *Paratrichodorus* spp., *P. christiei, P. minor, Ouinisulcius aculus*, and *Trichodorus* spp.

"Promoter" refers to a nucleotide sequence, usually upstream (5') to its coding sequence, which controls the expression of the coding sequence by providing the recognition for RNA polymerase and other factors required for proper transcription. "Promoter" includes a minimal promoter that is a short DNA sequence comprised of a TATA box and other sequences that serve to specify the site of transcription initiation, to which regulatory elements are added for control of expression. "Promoter" also refers to a nucleotide sequence that includes a minimal promoter plus regulatory elements that is capable of controlling the expression of a coding sequence or functional RNA. This type of promoter sequence consists of proximal and more distal upstream elements, the latter elements often referred to as enhancers. Accordingly, an "enhancer" is a DNA sequence which can stimulate promoter activity and may be an innate element of the promoter or a heterologous element inserted to enhance the level or tissue specificity of a promoter. It is capable of operating in both orientations (normal or flipped), and is capable of functioning even when moved either upstream or downstream from the promoter. Both enhancers and other upstream promoter elements bind sequence-specific DNA-binding proteins that mediate their effects. Promoters may be derived in their entirety from a native gene, or be composed of different elements derived from different promoters found in nature, or even be comprised of synthetic DNA segments. A promoter may also contain DNA sequences that are involved in the binding of protein factors which control the effectiveness of transcription initiation in response to physiological or developmental conditions.

The "initiation site" is the position surrounding the first nucleotide that is part of the transcribed sequence, which is also defined as position +1. With respect to this site all other sequences of the gene and its controlling regions are numbered. Downstream sequences (i.e., further protein encoding sequences in the 3' direction) are denominated positive, while upstream sequences (mostly of the controlling regions in the 5' direction) are denominated negative.

Promoter elements, particularly a TATA element, that are inactive or that have greatly reduced promoter activity in the absence of upstream activation are referred to as "minimal or core promoters." In the presence of a suitable transcription factor, the minimal promoter functions to permit transcription. A "minimal or core promoter" thus consists only of all basal elements needed for transcription initiation, e.g., a TATA box and/or an initiator.

"Constitutive expression" refers to expression using a constitutive or regulated promoter. "Conditional" and "regulated expression" refer to expression controlled by a regulated promoter.

"Constitutive promoter" refers to a promoter that is able to express the open reading frame (ORF) that it controls in all or nearly all of the plant tissues during all or nearly all developmental stages of the plant. Each of the transcription activating elements do not exhibit an absolute tissue-specificity, but mediate transcriptional activation in most plant parts at a level of $\geq 1\%$ of the level reached in the part of the plant in which transcription is most active.

"Regulated promoter" refers to promoters that direct gene expression not constitutively, but in a temporally- and/or spatially-regulated manner, and includes both tissue-specific and inducible promoters. It includes natural and synthetic sequences as well as sequences which may be a combination of synthetic and natural sequences. Different promoters may direct the expression of a gene in different tissues or cell types, or at different stages of development, or in response to different environmental conditions. New promoters of various types useful in plant cells are constantly being discovered; numerous examples may be found in the compilation by Okamuro et al. (1989). Typical regulated promoters useful in plants include but are not limited to safener-inducible promoters, promoters derived from the tetracycline-inducible system, promoters derived from salicylate-inducible systems, promoters derived from alcohol-inducible systems, promoters derived from glucocorticoid-inducible system, promoters derived from pathogen-inducible systems, and promoters derived from ecdysome-inducible systems.

"Tissue-specific promoter" refers to regulated promoters that are not expressed in all plant cells but only in one or more cell types in specific organs (such as leaves or seeds), specific tissues (such as embryo or cotyledon), or specific cell types (such as leaf parenchyma or seed storage cells). These also include promoters that are temporally regulated, such as in early or late embryogenesis, during fruit ripening in developing seeds or fruit, in fully differentiated leaf, or at the onset of senescence.

"Inducible promoter" refers to those regulated promoters that can be turned on in one or more cell types by an external stimulus, such as a chemical, light, hormone, stress, or a pathogen.

"Operably-linked" refers to the association of nucleic acid sequences on single nucleic acid fragment so that the function of one is affected by the other. For example, a regulatory DNA sequence is said to be "operably linked to" or "associated with" a DNA sequence that codes for an RNA or a polypeptide if the two sequences are situated such that the regulatory DNA sequence affects expression of the coding DNA sequence (i.e., that the coding sequence or functional RNA is under the transcriptional control of the promoter). Coding sequences can be operably-linked to regulatory sequences in sense or antisense orientation.

"Expression" refers to the transcription and/or translation of an endogenous gene, ORF or portion thereof, or a transgene in plants. For example, in the case of antisense constructs, expression may refer to the transcription of the antisense DNA only. In addition, expression refers to the transcription and stable accumulation of sense (mRNA) or functional RNA. Expression may also refer to the production of protein.

"Specific expression" is the expression of gene products which is limited to one or a few plant tissues (spatial limitation) and/or to one or a few plant developmental stages (temporal limitation). It is acknowledged that hardly a true specificity exists: promoters seem to be preferably switch on in some tissues, while in other tissues there can be no or only little activity. This phenomenon is known as leaky expression. However, with specific expression in this invention is meant preferable expression in one or a few plant tissues.

The "expression pattern" of a promoter (with or without enhancer) is the pattern of expression levels which shows where in the plant and in what developmental stage transcription is initiated by said promoter. Expression patterns of a set of promoters are said to be complementary when the expression pattern of one promoter shows little overlap with the expression pattern of the other promoter. The level of expression of a promoter can be determined by measuring the 'steady state' concentration of a standard transcribed reporter mRNA. This measurement is indirect since the concentration of the reporter mRNA is dependent not only on its synthesis rate, but also on the rate with which the mRNA is degraded. Therefore, the steady state level is the product of synthesis rates and degradation rates.

The rate of degradation can however be considered to proceed at a fixed rate when the transcribed sequences are identical, and thus this value can serve as a measure of synthesis rates. When promoters are compared in this way techniques available to those skilled in the art are hybridization S1-RNAse analysis, northern blots and competitive RT-PCR. This list of techniques in no way represents all available techniques, but rather describes commonly used procedures used to analyze transcription activity and expression levels of mRNA.

The analysis of transcription start points in practically all promoters has revealed that there is usually no single base at which transcription starts, but rather a more or less clustered set of initiation sites, each of which accounts for some start points of the mRNA. Since this distribution varies from promoter to promoter the sequences of the reporter mRNA in each of the populations would differ from each other. Since each mRNA species is more or less prone to degradation, no single degradation rate can be expected for different reporter mRNAs. It has been shown for various eukaryotic promoter sequences that the sequence surrounding the initiation site ('initiator') plays an important role in determining the level of RNA expression directed by that specific promoter. This includes also part of the transcribed sequences. The direct fusion of promoter to reporter sequences would therefore lead to suboptimal levels of transcription.

A commonly used procedure to analyze expression patterns and levels is through determination of the 'steady state' level of protein accumulation in a cell. Commonly used candidates for the reporter gene, known to those skilled in the art are ∃-glucuronidase (GUS), chloramphenicol acetyl transferase (CAT) and proteins with fluorescent properties, such as green fluorescent protein (GFP) from *Aequora victoria*. In principle, however, many more proteins are suitable for this purpose, provided the protein does not interfere with essential plant functions. For quantification and determination of localization a number of tools are suited. Detection systems can readily be created or are available which are based on, e.g., immunochemical, enzymatic, fluorescent detection and quantification. Protein levels can be determined in plant tissue extracts or in intact tissue using in situ analysis of protein expression.

Generally, individual transformed lines with one chimeric promoter reporter construct will vary in their levels of expression of the reporter gene. Also frequently observed is the phenomenon that such transformants do not express any detectable product (RNA or protein). The variability in expression is commonly ascribed to 'position effects', although the molecular mechanisms underlying this inactivity are usually not clear.

The term "average expression" is used here as the average level of expression found in all lines that do express detectable amounts of reporter gene, so leaving out of the analysis plants that do not express any detectable reporter mRNA or protein.

"Root expression level" indicates the expression level found in protein extracts of complete plant roots. Likewise, leaf, and stem expression levels, are determined using whole extracts from leaves and stems. It is acknowledged however, that within each of the plant parts just described, cells with variable functions may exist, in which promoter activity may vary.

"Non-specific expression" refers to constitutive expression or low level, basal ('leaky') expression in nondesired cells or tissues from a 'regulated promoter'.

"Altered levels" refers to the level of expression in transgenic organisms that differs from that of normal or untransformed organisms.

"Overexpression" refers to the level of expression in transgenic cells or organisms that exceeds levels of expression in normal or untransformed (nontransgenic) cells or organisms.

"Antisense inhibition" refers to the production of antisense RNA transcripts capable of suppressing the expression of protein from an endogenous gene or a transgene.

"Co-suppression" and "transwitch" each refer to the production of sense RNA transcripts capable of suppressing the expression of identical or substantially similar transgene or endogenous genes (U.S. Pat. No. 5,231,020).

"Gene silencing" refers to homology-dependent suppression of viral genes, transgenes, or endogenous nuclear genes. Gene silencing may be transcriptional, when the suppression is due to decreased transcription of the affected genes, or post-transcriptional, when the suppression is due to increased turnover (degradation) of RNA species homologous to the affected genes (English et al., 1996). Gene silencing includes virus-induced gene silencing (Ruiz et al. 1998).

"Silencing suppressor" gene refers to a gene whose expression leads to counteracting gene silencing and enhanced expression of silenced genes. Silencing suppressor genes may be of plant, nonplant, or viral origin. Examples include, but are not limited to HC-Pro, P1-HC-Pro, and 2b proteins. Other examples include one or more genes in TGMV-B genome.

The terms "heterologous DNA sequence," "exogenous DNA segment" or "heterologous nucleic acid," as used herein, each refer to a sequence that originates from a source foreign to the particular host cell or, if from the same source, is modified from its original form. Thus, a heterologous gene in a host cell includes a gene that is endogenous to the particular host cell but has been modified through, for example, the use of DNA shuffling. The terms also include non-naturally occurring multiple copies of a naturally occurring DNA sequence. Thus, the terms refer to a DNA segment that is foreign or heterologous to the cell, or homologous to the cell but in a position within the host cell nucleic acid in which the element is not ordinarily found. Exogenous DNA segments are expressed to yield exogenous polypeptides. A "homologous" DNA sequence is a DNA sequence that is naturally associated with a host cell into which it is introduced.

"Homologous to" in the context of nucleotide sequence identity refers to the similarity between the nucleotide sequence of two nucleic acid molecules or between the amino acid sequences of two protein molecules. Estimates of such homology are provided by either DNA-DNA or DNA-RNA hybridization under conditions of stringency as is well understood by those skilled in the art (as described in Haines and Higgins (eds.), Nucleic Acid Hybridization, IRL Press, Oxford, U.K.), or by the comparison of sequence similarity between two nucleic acids or proteins.

The term "substantially similar" refers to nucleotide and amino acid sequences that represent functional and/or structural equivalents of *Arabidopsis* sequences disclosed herein. For example, altered nucleotide sequences which simply reflect the degeneracy of the genetic code but nonetheless encode amino acid sequences that are identical to a particular amino acid sequence are substantially similar to the particular sequences. In addition, amino acid sequences that are substantially similar to a particular sequence are those wherein overall amino acid identity is at least 65% or greater to the instant sequences. Modifications that result in equivalent nucleotide or amino acid sequences are well within the routine skill in the art. Moreover, the skilled artisan recognizes that equivalent nucleotide sequences encompassed by this invention can also be defined by their ability to hybridize, under low, moderate and/or stringent conditions (e.g., 0.1× SSC, 0.1% SDS, 65° C.), with the nucleotide sequences that are within the literal scope of the instant claims.

"Target gene" refers to a gene on the replicon that expresses the desired target coding sequence, functional RNA, or protein. The target gene is not essential for replicon replication. Additionally, target genes may comprise native non-viral genes inserted into a non-native organism, or chimeric genes, and will be under the control of suitable regulatory sequences. Thus, the regulatory sequences in the target gene may come from any source, including the virus. Target genes may include coding sequences that are either heterologous or homologous to the genes of a particular plant to be transformed. However, target genes do not include native viral genes. Typical target genes include, but are not limited to genes encoding a structural protein, a seed storage protein, a protein that conveys herbicide resistance, and a protein that conveys insect resistance. Proteins encoded by target genes are known as "foreign proteins". The expression of a target gene in a plant will typically produce an altered plant trait.

The term "altered plant trait" means any phenotypic or genotypic change in a transgenic plant relative to the wild-type or nor-transgenic plant host.

"Transcription Stop Fragment" refers to nucleotide sequences that contain one or more regulatory signals, such as polyadenylation signal sequences, capable of terminating transcription. Examples include the 3' non-regulatory regions of genes encoding nopaline synthase and the small subunit of ribulose bisphosphate carboxylase.

"Replication gene" refers to a gene encoding a viral replication protein. In addition to the ORF of the replication protein, the replication gene may also contain other overlapping or non-overlapping ORF(s), as are found in viral sequences in nature. While not essential for replication, these additional ORFs may enhance replication and/or viral DNA accumulation. Examples of such additional ORFs are AC3 and AL3 in ACMV and TGMV geniniviruses, respectively.

"Chimeric trans-acting replication gene" refers either to a replication gene in which the coding sequence of a replication protein is under the control of a regulated plant promoter other than that in the native viral replication gene, or a modified native viral replication gene, for example, in which a site specific sequence(s) is inserted in the 5' transcribed but untranslated region. Such chimeric genes also include insertion of the known sites of replication protein binding between the promoter and the transcription start site that attenuate transcription of viral replication protein gene.

"Chromosomally-integrated" refers to the integration of a foreign gene or DNA construct into the host DNA by covalent bonds. Where genes are not "chromosomally integrated" they may be "transiently expressed." Transient expression of a gene refers to the expression of a gene that is not integrated into the host chromosome but functions independently, either as part of an autonomously replicating plasmid or expression cassette, for example, or as part of another biological system such as a virus.

"Production tissue" refers to mature, harvestable tissue consisting of non-dividing, terminally-differentiated cells. It excludes young, growing tissue consisting of germline, meristematic, and not-fully-differentiated cells.

"Germline cells" refer to cells that are destined to be gametes and whose genetic material is heritable.

"Trans-activation" refers to switching on of gene expression or replicon replication by the expression of another (regulatory) gene in trans.

The term "transformation" refers to the transfer of a nucleic acid fragment into the genome of a host cell, resulting in genetically stable inheritance. Host cells containing the transformed nucleic acid fragments are referred to as "transgenic" cells, and organisms comprising transgenic cells are referred to as "transgenic organisms". Examples of methods of transformation of plants and plant cells include *Agrobacterium*-mediated transformation (De Blaere et al., 1987) and particle bombardment technology (Klein et al. 1987; U.S. Pat. No. 4,945,050). Whole plants may be regenerated from transgenic cells by methods well known to the skilled artisan (see, for example, Fromm et al., 1990).

"Transformed," "transgenic," and "recombinant" refer to a host organism such as a bacterium or a plant into which a heterologous nucleic acid molecule has been introduced. The nucleic acid molecule can be stably integrated into the genome generally known in the art and are disclosed in Sambrook et al., 1989. See also Innis et al., 1995 and Gelfand, 1995; and Innis and Gelfand, 1999. Known methods of PCR include, but are not limited to, methods using paired primers, nested primers, single specific primers, degenerate primers, gene-specific primers, vector-specific primers, partially mismatched primers, and the like. For example, "transformed," "transformant," and "transgenic" plants or calli have been through the transformation process and contain a foreign gene integrated into their chromosome. The term "untransformed" refers to normal plants that have not been through the transformation process.

"Transiently transformed" refers to cells in which transgenes and foreign DNA have been introduced (for example, by such methods as Agrobacterium-mediated transformation or biolistic bombardment), but not selected for stable maintenance.

"Stably transformed" refers to cells that have been selected and regenerated on a selection media following transformation.

"Transient expression" refers to expression in cells in which a virus or a transgene is introduced by viral infection or by such methods as Agrobacterium-mediated transformation, electroporation, or biolistic bombardment, but not selected for its stable maintenance.

"Genetically stable" and "heritable" refer to chromosomally-integrated genetic elements that are stably maintained in the plant and stably inherited by progeny through successive generations.

"Primary transformant" and "T0 generation" refer to transgenic plants that are of the same genetic generation as the tissue which is initially transformed (i.e., not having gone through meiosis and fertilization since transformation).

"Secondary transformants" and the "T1, T2, T3, etc. generations" refer to transgenic plants derived from primary transformants through one or more meiotic and fertilization cycles. They may be derived by self-fertilization of primary or secondary transformants or crosses of primary or secondary transformants with other transformed or untransformed plants.

"Wild-type" refers to a virus or organism found in nature without any known mutation.

"Genome" refers to the complete genetic material of an organism.

The term "nucleic acid" refers to deoxyribonucleotides or ribonucleotides and polymers thereof in either single- or double-stranded form, composed of monomers (nucleotides) containing a sugar, phosphate and a base which is either a purine or pyrimidine. Unless specifically limited, the term encompasses nucleic acids containing known analogs of natural nucleotides which have similar binding properties as the reference nucleic acid and are metabolized in a manner similar to naturally occurring nucleotides. Unless otherwise indicated, a particular nucleic acid sequence also implicitly encompasses conservatively modified variants thereof (e.g., degenerate codon substitutions) and complementary sequences as well as the sequence explicitly indicated. Specifically, degenerate codon substitutions may be achieved by generating sequences in which the third position of one or more selected (or all) codons is substituted with mixed-base and/or deoxyinosine residues (Batzer et al., 1991; Ohtsuka et al., 1985; Rossolini et al. 1994). A "nucleic acid fragment" is a fraction of a given nucleic acid molecule. In higher plants, deoxyribonucleic acid (DNA) is the genetic material while ribonucleic acid (RNA) is involved in the transfer of information contained within DNA into proteins. The term "nucleotide sequence" refers to a polymer of DNA or RNA which can be single- or double-stranded, optionally containing synthetic, non-natural or altered nucleotide bases capable of incorporation into DNA or RNA polymers. The terms "nucleic acid" or "nucleic acid sequence" may also be used interchangeably with gene, cDNA, DNA and RNA encoded by a gene.

The invention encompasses isolated or substantially purified nucleic acid or protein compositions. In the context of the present invention, an "isolated" or "purified" DNA molecule or an "isolated" or "purified" polypeptide is a DNA molecule or polypeptide that, by the hand of man, exists apart from its native environment and is therefore not a product of nature. An isolated DNA molecule or polypeptide may exist in a purified form or may exist in a non-native environment such as, for example, a transgenic host cell. For example, an "isolated" or "purified" nucleic acid molecule or protein, or biologically active portion thereof, is substantially free of other cellular material, or culture medium when produced by recombinant techniques, or substantially free of chemical precursors or other chemicals when chemically synthesized. Preferably, an "isolated" nucleic acid is free of sequences (preferably protein encoding sequences) that naturally flank the nucleic acid (i.e., sequences located at the 5' and 3' ends of the nucleic acid) in the genomic DNA of the organism from which the nucleic acid is derived. For example, in various embodiments, the isolated nucleic acid molecule can contain less than about 5 kb, 4 kb, 3 kb, 2 kb, 1 kb, 0.5 kb, or 0.1 kb of nucleotide sequences that naturally flank the nucleic acid molecule in genomic DNA of the cell from which the nucleic acid is derived. A protein that is substantially free of cellular material includes preparations of protein or polypeptide having less than about 30%, 20%, 10%, 5%, (by dry weight) of contaminating protein. When the protein of the invention, or biologically active portion thereof, is recombinantly produced, preferably culture medium represents less than about 30%, 20%, 10%, or 5% (by dry weight) of chemical precursors or non-protein of interest chemicals.

The nucleotide sequences of the invention include both the naturally occurring sequences as well as mutant (variant) forms. Such variants will continue to possess the desired activity, i.e., either promoter activity or the activity of the product encoded by the open reading frame of the non-variant nucleotide sequence.

Thus, by "variants" is intended substantially similar sequences. For nucleotide sequences comprising an open reading frame, variants include those sequences that, because of the degeneracy of the genetic code, encode the identical amino acid sequence of the native protein. Naturally occurring allelic variants such as these can be identified with the use of well-known molecular biology techniques, as, for example, with polymerase chain reaction (PCR) and hybridization techniques. Variant nucleotide sequences also include synthetically derived nucleotide sequences, such as those generated, for example, by using site-directed mutagenesis and for open reading frames, encode the native protein, as well as those that encode a polypeptide having amino acid substitutions relative to the native protein. Generally, nucleotide sequence variants of the invention will have at least 40, 50, 60, to 70%, e.g., preferably 71%, 72%, 73%, 74%, 75%, 76%, 77%, 78%, to 79%, generally at least 80%, e.g., 81%-84%, at least 85%, e.g., 86%, 87%, 88%, 89%, 90%, 91%, 92%, 93%, 94%, 95%, 96%, 97%, to 98% and 99% nucleotide sequence identity to the native (wild type or endogenous) nucleotide sequence.

"Conservatively modified variations" of a particular nucleic acid sequence refers to those nucleic acid sequences that encode identical or essentially identical amino acid sequences, or where the nucleic acid sequence does not encode an amino acid sequence, to essentially identical sequences. Because of the degeneracy of the genetic code, a large number of functionally identical nucleic acids encode any given polypeptide. For instance the codons CGT, CGC, CGA, CGG, AGA, and AGG all encode the amino acid arginine. Thus, at every position where an arginine is specified by a codon, the codon can be altered to any of the corresponding codons described without altering the encoded protein. Such nucleic acid variations are "silent variations" which are one species of "conservatively modified variations." Every nucleic acid sequence described herein which encodes a polypeptide also describes every possible silent variation, except where otherwise noted. One of skill will recognize that each codon in a nucleic acid (except ATG, which is ordinarily the only codon for methionine) can be modified to yield a functionally identical molecule by standard techniques. Accordingly, each "silent variation" of a nucleic acid which encodes a polypeptide is implicit in each described sequence.

The nucleic acid molecules of the invention can be "optimized" for enhanced expression in plants of interest. See, for example, EPA 035472; WO 91/16432; Perlak et al., 1991; and Murray et al., 1989. In this manner, the open reading frames in genes or gene fragments can be synthesized utilizing plant-preferred codons. See, for example, Campbell and Gowri, 1990 for a discussion of host-preferred codon usage. Thus, the nucleotide sequences can be optimized for expression in any plant. It is recognized that all or any part of the gene sequence may be optimized or synthetic. That is, synthetic or partially optimized sequences may also be used. Variant nucleotide sequences and proteins also encompass sequences and protein derived from a mutagenic and recombinogenic procedure such as DNA shuffling. With such a procedure, one or more different coding sequences can be manipulated to create a new polypeptide possessing the desired properties. In this manner, libraries of recombinant polynucleotides are generated from a population of related sequence polynucleotides comprising sequence regions that have substantial sequence identity and can be homologously recombined in vitro or in vivo. Strategies for such DNA shuffling are known in the art. See, for example, Stemmer, 1994; Stemmer, 1994; Crameri et al., 1997; Moore et al., 1997; Zhang et al., 1997; Crameri et al., 1998; and U.S. Pat. Nos. 5,605,793 and 5,837,458.

By "variant" polypeptide is intended a polypeptide derived from the native protein by deletion (so-called truncation) or addition of one or more amino acids to the N-terminal and/or C-terminal end of the native protein; deletion or addition of one or more amino acids at one or more sites in the native protein; or substitution of one or more amino acids at one or more sites in the native protein. Such variants may result from, for example, genetic polymorphism or from human manipulation. Methods for such manipulations are generally known in the art.

Thus, the polypeptides may be altered in various ways including amino acid substitutions, deletions, truncations, and insertions. Methods for such manipulations are generally known in the art. For example, amino acid sequence variants of the polypeptides can be prepared by mutations in the DNA. Methods for mutagenesis and nucleotide sequence alterations are well known in the art. See, for example, Kunkel, 1985; Kunkel et al., 1987; U.S. Pat. No. 4,873,192; Walker and Gaastra, 1983 and the references cited therein. Guidance as to appropriate amino acid substitutions that do not affect biological activity of the protein of interest may be found in the model of Dayhoff et al. (1978). Conservative substitutions, such as exchanging one amino acid with another having similar properties, are preferred.

Individual substitutions deletions or additions that alter, add or delete a single amino acid or a small percentage of amino acids (typically less than 5%, more typically less than 1%) in an encoded sequence are "conservatively modified variations," where the alterations result in the substitution of an amino acid with a chemically similar amino acid. Conservative substitution tables providing functionally similar amino acids are well known in the art. The following five groups each contain amino acids that are conservative substitutions for one another, Aliphatic: Glycine (G), Alanine (A), Valine (V), Leucine (L), Isoleucine (I); Aromatic: Phenylalanine (F), Tyrosine (Y), Tryptophan (W); Sulfur-containing: Methionine (M), Cysteine (C); Basic: Arginine I, Lysine (K), Histidine (H); Acidic: Aspartic acid (D), Glutamic acid (E), Asparagine (N), Glutamine (Q). See also, Creighton, 1984. In addition, individual substitutions, deletions or additions which alter, add or delete a single amino acid or a small percentage of amino acids in an encoded sequence are also "conservatively modified variations."

"Expression cassette" as used herein means a DNA sequence capable of directing expression of a particular nucleotide sequence in an appropriate host cell, comprising a promoter operably linked to the nucleotide sequence of interest which is operably linked to termination signals. It also typically comprises sequences required for proper translation of the nucleotide sequence. The coding region usually codes for a protein of interest but may also code for a functional RNA of interest, for example antisense RNA or a nontranslated RNA, in the sense or antisense direction. The expression cassette comprising the nucleotide sequence of interest may be chimeric, meaning that at least one of its components is heterologous with respect to at least one of its other components. The expression cassette may also be one which is naturally occurring but has been obtained in a recombinant form useful for heterologous expression. The expression of the nucleotide sequence in the expression cassette may be under the control of a constitutive promoter or of an inducible promoter which initiates transcription only when the host cell is exposed to some particular external stimulus. In the case of a multicellular organism, the promoter can also be specific to a particular tissue or organ or stage of development.

"Vector" is defined to include, inter alia, any plasmid, cosmid, phage or *Agrobacterium* binary vector in double or single stranded linear or circular form which may or may not be self transmissible or mobilizable, and which can transform prokaryotic or eukaryotic host either by integration into the cellular genome or exist extrachromosomally (e.g. autonomous replicating plasmid with an origin of replication).

Specifically included are shuttle vectors by which is meant a DNA vehicle capable, naturally or by design, of replication in two different host organisms, which may be selected from actinomycetes and related species, bacteria and eukaryotic (e.g. higher plant, mammalian, yeast or fungal cells).

Preferably the nucleic acid in the vector is under the control of, and operably linked to, an appropriate promoter or other regulatory elements for transcription in a host cell such as a microbial, e.g. bacterial, or plant cell. The vector may be a bi-functional expression vector which functions in multiple hosts. In the case of genomic DNA, this may contain its own promoter or other regulatory elements and in the case of cDNA this may be under the control of an appropriate promoter or other regulatory elements for expression in the host cell.

"Cloning vectors" typically contain one or a small number of restriction endonuclease recognition sites at which foreign DNA sequences can be inserted in a determinable fashion without loss of essential biological function of the vector, as well as a marker gene that is suitable for use in the identification and selection of cells transformed with the cloning vector. Marker genes typically include genes that provide tetracycline resistance, hygromycin resistance or ampicillin resistance.

A "tralsgenic plant" is a plant having one or more plant cells that contain an expression vector.

"Plant tissue" includes differentiated and undifferentiated tissues or plants, including but not limited to roots, stems, shoots, leaves, pollen, seeds, tumor tissue and various forms of cells and culture such as single cells, protoplast, embryos, and callus tissue. The plant tissue may be in plants or in organ, tissue or cell culture.

The following terms are used to describe the sequence relationships between two or more nucleic acids or polynucleotides: (a) "reference sequence", (b) "comparison window", (c) "sequence identity", (d) "percentage of sequence identity", and (e) "substantial identity".

(a) As used herein, "reference sequence" is a defined sequence used as a basis for sequence comparison. A reference sequence may be a subset or the entirety of a specified sequence; for example, as a segment of a full length cDNA or gene sequence, or the complete cDNA or gene sequence.

(b) As used herein, "comparison window" makes reference to a contiguous and specified segment of a polynucleotide sequence, wherein the polynucleotide sequence in the comparison window may comprise additions or deletions (i.e., gaps) compared to the reference sequence (which does not comprise additions or deletions) for optimal alignment of the two sequences. Generally, the comparison window is at least 20 contiguous nucleotides in length, and optionally can be 30, 40, 50, 100, or longer. Those of skill in the art understand that to avoid a high similarity to a reference sequence due to inclusion of gaps in the polynucleotide sequence a gap penalty is typically introduced and is subtracted from the number of matches.

Methods of alignment of sequences for comparison are well known in the art. Thus, the determination of percent identity between any two sequences can be accomplished using a mathematical algorithm. Preferred, non-limiting examples of such mathematical algorithms are the algorithm of Myers and Miller, 1988; the local homology algorithm of Smith et al. 1981; the homology alignment algorithm of Needleman and Wunsch 1970; the search-for-similarity-method of Pearson and Lipman 1988; the algorithm of Karlin and Altschul, 1990, modified as in Karlin and Altschul, 1993.

Computer implementations of these mathematical algorithms can be utilized for comparison of sequences to determine sequence identity. Such implementations include, but are not limited to: CLUSTAL in the PC/Gene program (available from Intelligenetics, Mountain View, Calif.); the ALIGN program (Version 2.0) and GAP, BESTFIT, BLAST, FASTA, and TFASTA in the Wisconsin Genetics Software Package, Version 8 (available from Genetics Computer Group (GCG), 575 Science Drive, Madison, Wis., USA). Alignments using these programs can be performed using the default parameters. The CLUSTAL program is well described by Higgins et al. 1988; Higgins et al. 1989; Corpet et al. 1988; Huang et al. 1992; and Pearson et al. 1994. The ALIGN program is based on the algorithm of Myers and Miller, supra. The BLAST programs of Altschul et al., 1990, are based on the algorithm of Karlin and Altschul supra.

Software for performing BLAST analyses is publicly available through the National Center for Biotechnology Information. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., 1990). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when the cumulative alignment score falls off by the quantity X from its maximum achieved value, the cumulative score goes to zero or below due to the accumulation of one or more negative-scoring residue alignments, or the end of either sequence is reached.

In addition to calculating percent sequence identity, the BLAST algorithm also performs a statistical analysis of the similarity between two sequences (see, e.g., Karlin & Altschul (1993). One measure of similarity provided by the BLAST algorithm is the smallest sum probability (P(N)), which provides an indication of the probability by which a match between two nucleotide or amino acid sequences would occur by chance. For example, a test nucleic acid sequence is considered similar to a reference sequence if the smallest sun probability in a comparison of the test nucleic acid sequence to the reference nucleic acid sequence is less than about 0.1, more preferably less than about 0.01, and most preferably less than about 0.001.

To obtain gapped alignments for comparison purposes, Gapped BLAST (in BLAST 2.0) can be utilized as described in Altschul et al. 1997. Alternatively, PSI-BLAST (in BLAST 2.0) can be used to perform an iterated search that detects distant relationships between molecules. See Altschul et al., supra. When utilizing BLAST, Gapped BLAST, PSI-BLAST, the default parameters of the respective programs (e.g. BLASTN for nucleotide sequences, BLASTX for proteins) can be used. The BLASTN program (for nucleotide sequences) uses as defaults a wordlength (W) of 11, an expectation (E) of 10, a cutoff of 100, M=5, N=4, and a comparison of both strands. For amino acid sequences, the BLASTP program uses as defaults a wordlength (W) of 3, an expectation (E) of 10, and the BLOSUM62 scoring matrix (see Henikoff & Henikoff, 1989). Alignment may also be performed manually by inspection.

For purposes of the present invention, comparison of nucleotide sequences for determination of percent sequence identity to the promoter sequences disclosed herein is preferably made using the BlastN program (version 1.4.7 or later) with its default parameters or any equivalent program. By "equivalent program" is intended any sequence comparison program that, for any two sequences in question, generates an alignment having identical nucleotide or amino acid residue matches and an identical percent sequence identity when compared to the corresponding alignment generated by the preferred program.

(c) As used herein, "sequence identity" or "identity" in the context of two nucleic acid or polypeptide sequences makes reference to the residues in the two sequences that are the same when aligned for maximum correspondence over a specified comparison window. When percentage of sequence identity is used in reference to proteins it is recognized that residue positions which are not identical often differ by conservative amino acid substitutions, where amino acid residues are substituted for other amino acid residues with similar chemical properties (e.g., charge or hydrophobicity) and therefore do not change the functional properties of the molecule. When sequences differ in conservative substitutions, the percent sequence identity may be adjusted upwards to correct for the conservative nature of the substitution. Sequences that differ by such conservative substitutions are said to have "sequence similarity" or "similarity." Means for making this adjustment are well known to those of skill in the art. Typically this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated, e.g., as implemented in the program PC/GENE (Intelligenetics, Mountain View, Calif.).

(d) As used herein, "percentage of sequence identity" means the value determined by comparing two optimally aligned sequences over a comparison window, wherein the portion of the polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison, and multiplying the result by 100 to yield the percentage of sequence identity.

(e)(i) The term "substantial identity" of polynucleotide sequences means that a polynucleotide comprises a sequence that has at least 70%, 71%, 72%, 73%, 74%, 75%, 76%, 77%, 78%, or 79%, preferably at least 80%, 81%, 82%, 83%, 84%, 85%, 86%, 87%, 88%, or 89%, more preferably at least 90%, 91%, 92%, 93%, or 94%, and most preferably at least 95%, 96%, 97%, 98%, or 99% sequence identity, compared to a reference sequence using one of the alignment programs described using standard parameters. One of skill in the art will recognize that these values can be appropriately adjusted to determine corresponding identity of proteins encoded by two nucleotide sequences by taking into account codon degeneracy, amino acid similarity, reading frame positioning, and the like. Substantial identity of amino acid sequences for these purposes normally means sequence identity of at least 70%, more preferably at least 80%, 90%, and most preferably at least 95%.

Another indication that nucleotide sequences are substantially identical is if two molecules hybridize to each other under stringent conditions (see below). Generally, stringent conditions are selected to be about 5° C. lower than the thermal melting point ($T_m$) for the specific sequence at a defined ionic strength and pH. However, stringent conditions encompass temperatures in the range of about 1° C. to about 20° C., depending upon the desired degree of stringency as otherwise qualified herein. Nucleic acids that do not hybridize to each other under stringent conditions are still substantially identical if the polypeptides they encode are substantially identical. This may occur, e.g., when a copy of a nucleic acid is created using the maximum codon degeneracy permitted by the genetic code. One indication that two nucleic acid sequences are substantially identical is when the polypeptide encoded by the first nucleic acid is immunologically cross reactive with the polypeptide encoded by the second nucleic acid.

(e)(ii) The term "substantial identity" in the context of a peptide indicates that a peptide comprises a sequence with at least 70%, 71%, 72%, 73%, 74%, 75%, 76%, 77%, 78%, or 79%, preferably 80%, 81%, 82%, 83%, 84%, 85%, 86%, 87%, 88%, or 89%, more preferably at least 90%, 91%, 92%, 93%, or 94%, or even more preferably, 95%, 96%, 97%, 98% or 99%, sequence identity to the reference sequence over a specified comparison window. Preferably, optimal alignment is conducted using the homology alignment algorithm of Needleman and Wunsch (1970). An indication that two peptide sequences are substantially identical is that one peptide is immunologically reactive with antibodies raised against the second peptide. Thus, a peptide is substantially identical to a second peptide, for example, where the two peptides differ only by a conservative substitution.

For sequence comparison, typically one sequence acts as a reference sequence to which test sequences are compared. When using a sequence comparison algorithm, test and reference sequences are input into a computer, subsequence coordinates are designated if necessary, and sequence algorithm program parameters are designated. The sequence comparison algorithm then calculates the percent sequence identity for the test sequence(s) relative to the reference sequence, based on the designated program parameters.

As noted above, another indication that two nucleic acid sequences are substantially identical is that the two molecules hybridize to each other under stringent conditions. The phrase "hybridizing specifically to" refers to the binding, duplexing, or hybridizing of a molecule only to a particular nucleotide sequence under stringent conditions when that sequence is present in a complex mixture (e.g., total cellular) DNA or RNA. "Bind(s) substantially" refers to complementary hybridization between a probe nucleic acid and a target nucleic acid and embraces minor mismatches that can be accommodated by reducing the stringency of the hybridization media to achieve the desired detection of the target nucleic acid sequence.

"Stringent hybridization conditions" and "stringent hybridization wash conditions" in the context of nucleic acid hybridization experiments such as Southern and Northern hybridization are sequence dependent, and are different under different environmental parameters. The $T_m$ is the temperature (under defined ionic strength and pH) at which 50% of the target sequence hybridizes to a perfectly matched probe. Specificity is typically the function of post-hybridization washes, the critical factors being the ionic strength and temperature of the final wash solution. For DNA-DNA hybrids, the $T_m$ can be approximated from the equation of Meinkoth and Wahl, 1984; $T_m$ 81.5° C.+16.6 (log M)+0.41 (% GC)−0.61 (% form)−500/L; where M is the molarity of monovalent cations, % GC is the percentage of guanosine and cytosine nucleotides in the DNA, % form is the percentage of formamide in the hybridization solution, and L is the length of the hybrid in base pairs. $T_m$ is reduced by about 1° C. for each 1% of mismatching; thus, $T_m$, hybridization, and/or wash conditions can be adjusted to hybridize to sequences of the desired identity. For example, if sequences with >90% identity are sought, the $T_m$ can be decreased 10° C. Generally, stringent conditions are selected to be about 5° C. lower than the thermal melting point I for the specific sequence and its complement at a defined ionic strength and pH. However, severely stringent conditions can utilize a hybridization and/or wash at 1, 2, 3, or 4° C. lower than the thermal melting point I; moderately stringent conditions can utilize a hybridization and/or wash at 6, 7, 8, 9, or 10° C. lower than the thermal melting point I; low stringency conditions can utilize a hybridization and/or wash at 11, 12, 13, 14, 15, or 20° C. lower than the thermal melting point I. Using the equation, hybridization and wash compositions, and desired T, those of ordinary skill will understand that variations in the stringency of hybridization and/or wash solutions are inherently described. If the desired degree of mismatching results in a T of less than 45° C. (aqueous solution) or 32° C. (formamide solution), it is preferred to increase the SSC concentration so that a higher temperature can be used. An extensive guide to the hybridization of nucleic acids is found in Tijssen, 1993. Generally, highly stringent hybridization and wash conditions are selected to be about 5° C. lower than the thermal melting point $T_m$ for the specific sequence at a defined ionic strength and pH.

An example of highly stringent wash conditions is 0.15 M NaCl at 72° C. for about 15 minutes. An example of stringent wash conditions is a 0.2×SSC wash at 65° C. for 15 minutes (see, Sambrook, infra, for a description of SSC buffer). Often, a high stringency wash is preceded by a low stringency wash to remove background probe signal. An example medium stringency wash for a duplex of, e.g., more than 100 nucleotides, is 1×SSC at 45° C. for 15 minutes. An example low stringency wash for a duplex of, e.g., more than 100 nucleotides, is 4-6×SSC at 40° C. for 15 minutes. For short probes (e.g., about 10 to 50 nucleotides), stringent conditions typically involve salt concentrations of less than about 1.5 M, more preferably about 0.01 to 1.0 M, Na ion concentration (or other salts) at pH 7.0 to 8.3, and the temperature is typically at least about 30° C. and at least about 60° C. for long robes (e.g., >50 nucleotides). Stringent conditions may also be achieved with the addition of destabilizing agents such as formamide. In general, a signal to noise ratio of 2× (or higher) than that observed for an unrelated probe in the particular hybridization assay indicates detection of a specific hybridization. Nucleic acids that do not hybridize to each other under stringent conditions are still substantially identical if the proteins that they encode are substantially identical. This occurs, e.g., when a copy of a nucleic acid is created using the maximum codon degeneracy permitted by the genetic code.

Very stringent conditions are selected to be equal to the $T_m$ for a particular probe. An example of stringent conditions for hybridization of complementary nucleic acids which have more than 100 complementary residues on a filter in a Southern or Northern blot is 50% formamide, e.g., hybridization in 50% formamide, 1 M NaCl, 1% SDS at 37° C., and a wash in 0.1×SSC at 60 to 65° C. Exemplary low stringency conditions include hybridization with a buffer solution of 30 to 35% formamide, 1 M NaCl, 1% SDS (sodium dodecyl sulphate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1.0 M NaCl, 1% SDS at 37° C., and a wash in 0.5× to 1×SSC at 55 to 60° C.

The following are examples of sets of hybridization/wash conditions that may be used to clone orthologous nucleotide sequences that are substantially identical to reference nucleotide sequences of the present invention: a reference nucleotide sequence preferably hybridizes to the reference nucleotide sequence in 7% sodium dodecyl sulfate (SDS), 0.5 M NaPO$_4$, 1 mM EDTA at 50° C. with washing in 2×SSC, 0.1% SDS at 50° C., more desirably in 7% sodium dodecyl sulfate (SDS), 0.5 M NaPO$_4$, 1 mM EDTA at 50° C. with washing in 1×SSC, 0.1% SDS at 50° C., more desirably still in 7% sodium dodecyl sulfate (SDS), 0.5 M NaPO$_4$, 1 mM EDTA at 50° C. with washing in 0.5×SSC, 0.1% SDS at 50° C., preferably in 7% sodium dodecyl sulfate (SDS), 0.5 M NaPO$_4$, 1 mM EDTA at 50° C. with washing in 0.1×SSC, 0.1% SDS at 50° C., more preferably in 7% sodium dodecyl sulfate (SDS), 0.5 M NaPO$_4$, 1 mM EDTA at 50° C. with washing in 0.1× SSC, 0.1% SDS at 65° C.

"DNA shuffling" is a method to introduce mutations or rearrangements, preferably randomly, in a DNA molecule or to generate exchanges of DNA sequences between two or more DNA molecules, preferably randomly. The DNA molecule resulting from DNA shuffling is a shuffled DNA molecule that is a non-naturally occurring DNA molecule derived from at least one template DNA molecule. The shuffled DNA preferably encodes a variant polypeptide modified with respect to the polypeptide encoded by the template DNA, and may have an altered biological activity with respect to the polypeptide encoded by the template DNA.

"Recombinant DNA molecule" is a combination of DNA sequences that are joined together using recombinant DNA technology and procedures used to join together DNA sequences as described, for example, in Sambrook et al., 1989.

The word "plant" refers to any plant, particularly to seed plant, and "plant cell" is a structural and physiological unit of the plant, which comprises a cell wall but may also refer to a protoplast. The plant cell may be in form of an isolated single cell or a cultured cell, or as a part of higher organized unit such as, for example, a plant tissue, or a plant organ.

"Significant increase" is an increase that is larger than the margin of error inherent in the measurement technique, preferably an increase by about 2-fold or greater.

"Significantly less" means that the decrease is larger than the margin of error inherent in the measurement technique, preferably a decrease by about 2-fold or greater.

Virtually any DNA composition may be used for delivery to recipient plant cells, e.g., monocotyledonous cells, to ultimately produce fertile transgenic plants in accordance with the present invention. For example, DNA segments in the form of vectors and plasmids, or linear DNA fragments, in some instances containing only the DNA element to be expressed in the plant, and the like, may be employed. The construction of vectors which may be employed in conjunction with the present invention will be known to those of skill of the art in light of the present disclosure (see, e.g., Sambrook et al., 1989; Gelvin et al., 1990).

Vectors, plasmids, cosmids, YACs (yeast artificial chromosomes), BACs (bacterial artificial chromosomes) and DNA segments for use in transforming such cells will, of course, generally comprise the cDNA, gene or genes which one desires to introduce into the cells. These DNA constructs can further include structures such as promoters, enhancers, polylinkers, or even regulatory genes as desired. The DNA segment or gene chosen for cellular introduction will often encode a protein which will be expressed in the resultant recombinant cells, such as will result in a screenable or selectable trait and/or which will impart an improved phenotype to the regenerated plant. However, this may not always be the case, and the present invention also encompasses transgenic plants incorporating non-expressed transgenes.

In certain embodiments, it is contemplated that one may wish to employ replication-competent viral vectors in monocot transformation. Such vectors include, for example, wheat dwarf virus (WDV) "shuttle" vectors, such as pW1-11 and PW1-GUS (Ugaki et al., 1991). These vectors are capable of autonomous replication in maize cells as well as *E. coli*, and as such may provide increased sensitivity for detecting DNA delivered to transgenic cells. A replicating vector may also be useful for delivery of genes flanked by DNA sequences from transposable elements such as Ac, Ds, or Mu. It has been proposed (Laufs et al., 1990) that transposition of these elements within the maize genome requires DNA replication. It is also contemplated that transposable elements would be useful for introducing DNA fragments lacking elements necessary for selection and maintenance of the plasmid vector in bacteria, e.g., antibiotic resistance genes and origins of DNA replication. It is also proposed that use of a transposable element such as Ac, Ds, or Mu would actively promote integration of the desired DNA and hence increase the frequency of stably transformed cells. The use of a transposable element such as Ac, Ds, or Mu may actively promote integration of the DNA of interest and hence increase the frequency of stably transformed cells. Transposable elements may be useful to allow separation of genes of interest from elements necessary for selection and maintenance of a plasmid vector in bacteria or selection of a transformant. By use of a transposable element, desirable and undesirable DNA sequences may be transposed apart from each other in the genome, such that through genetic segregation in progeny, one may identify plants with either the desirable or the undesirable DNA sequences.

DNA useful for introduction into plant cells includes that which has been derived or isolated from any source, that may be subsequently characterized as to structure, size and/or function, chemically altered, and later introduced into plants. An example of DNA "derived" from a source, would be a DNA sequence that is identified as a useful fragment within a given organism, and which is then chemically synthesized in essentially pure form. An example of such DNA "isolated" from a source would be a useful DNA sequence that is excised or removed from said source by chemical means, e.g., by the use of restriction endonucleases, so that it can be further manipulated, e.g., amplified, for use in the invention, by the methodology of genetic engineering. Such DNA is commonly referred to as "recombinant DNA."

Therefore useful DNA includes completely synthetic DNA, semi-synthetic DNA, DNA isolated from biological sources, and DNA derived from introduced RNA. Generally, the introduced DNA is not originally resident in the plant genotype which is the recipient of the DNA, but it is within the scope of the invention to isolate a gene from a given plant genotype, and to subsequently introduce multiple copies of the gene into the same genotype, e.g., to enhance production of a given gene product such as a storage protein or a protein that confers tolerance or resistance to water deficit.

The introduced DNA includes but is not limited to, DNA from plant genes, and non-plant genes such as those from bacteria, yeasts, animals or viruses. The introduced DNA can include modified genes, portions of genes, or chimeric genes, including genes from the same or different maize genotype. The term "chimeric gene" or "chimeric DNA" is defined as a gene or DNA sequence or segment comprising at least two DNA sequences or segments from species which do not combine DNA under natural conditions, or which DNA sequences or segments are positioned or linked in a manner which does not normally occur in the native genome of untransformed plant.

The introduced DNA used for transformation herein may be circular or linear, double-stranded or single-stranded. Generally, the DNA is in the form of chimeric DNA, such as plasmid DNA, that can also contain coding regions flanked by regulatory sequences which promote the expression of the recombinant DNA present in the resultant plant. For example, the DNA may itself comprise or consist of a promoter that is active in a plant which is derived from a source other than that plant, or may utilize a promoter already present in a plant genotype that is the transformation target.

Generally, the introduced DNA will be relatively small, i.e., less than about 30 kb to minimize any susceptibility to physical, chemical, or enzymatic degradation which is known to increase as the size of the DNA increases. As noted above, the number of proteins, RNA transcripts or mixtures thereof which is introduced into the plant genome is preferably preselected and defined, e.g., from one to about 5-10 such products of the introduced DNA may be formed.

Two principal methods for the control of expression are known, viz.: overexpression and underexpression. Overexpression can be achieved by insertion of one or more than one extra copy of the selected gene. It is, however, not unknown for plants or their progeny, originally transformed with one or more than one extra copy of a nucleotide sequence, to exhibit the effects of underexpression as well as overexpression. For underexpression there are two principle methods which are commonly referred to in the art as "antisense downregulation" and "sense downregulation" (sense downregulation is also referred to as "cosuppression"). Generically these processes are referred to as "gene silencing". Both of these methods lead to an inhibition of expression of the target gene.

Obtaining sufficient levels of transgene expression in the appropriate plant tissues is an important aspect in the production of genetically engineered crops. Expression of heterologous DNA sequences in a plant host is dependent upon the presence of an operably linked promoter that is functional within the plant host. Choice of the promoter sequence will determine when and where within the organism the heterologous DNA sequence is expressed.

Furthermore, it is contemplated that promoters combining elements from more than one promoter may be useful. For example, U.S. Pat. No. 5,491,288 discloses combining a Cauliflower Mosaic Virus promoter with a histone promoter. Thus, the elements from the promoters disclosed herein may be combined with elements from other promoters.

Promoters which are useful for plant transgene expression include those that are inducible, viral, synthetic, constitutive (Odell et al., 1985), temporally regulated, spatially regulated, tissue-specific, and spatio-temporally regulated.

Where expression in specific tissues or organs is desired, tissue-specific promoters may be used. In contrast, where gene expression in response to a stimulus is desired, inducible promoters are the regulatory elements of choice. Where continuous expression is desired throughout the cells of a plant, constitutive promoters are utilized. Additional regulatory sequences upstream and/or downstream from the core promoter sequence may be included in expression constructs of transformation vectors to bring about varying levels of expression of heterologous nucleotide sequences in a transgenic plant.

The choice of promoter will vary depending on the temporal and spatial requirements for expression, and also depending on the target species. In some cases, expression in multiple tissues is desirable. While in others, tissue-specific, e.g., leaf-specific, seed-specific, petal-specific, anther-specific, or pith-specific, expression is desirable. Although many promoters from dicotyledons have been shown to be operational in monocotyledons and vice versa, ideally dicotyledonous promoters are selected for expression in dicotyledons, and monocotyledonous promoters for expression in monocotyledons. However, there is no restriction to the provenance of selected promoters; it is sufficient that they are operational in driving the expression of the nucleotide sequences in the desired cell.

These promoters include, but are not limited to, constitutive, inducible, temporally regulated, developmentally regulated, spatially-regulated, chemically regulated, stress-responsive, tissue-specific, viral and synthetic promoters. Promoter sequences are known to be strong or weak. A strong promoter provides for a high level of gene expression, whereas a weak promoter provides for a very low level of gene expression. An inducible promoter is a promoter that provides for the turning on and off of gene expression in response to an exogenously added agent or to an environmental or developmental stimulus. A bacterial promoter such as the $P_{tac}$ promoter can be induced to varying levels of gene expression depending on the level of isothiopropylgalactoside added to the transformed bacterial cells. An isolated promoter sequence that is a strong promoter for heterologous nucleic acid is advantageous because it provides for a sufficient level of gene expression to allow for easy detection and selection of transformed cells and provides for a high level of gene expression when desired.

Within a plant promoter region there are several domains that are necessary for full function of the promoter. The first of these domains lies immediately upstream of the structural gene and forms the "core promoter region" containing consensus sequences, normally 70 base pairs immediately upstream of the gene. The core promoter region contains the characteristic CAAT and TATA boxes plus surrounding sequences, and represents a transcription initiation sequence that defines the transcription start point for the structural gene.

The presence of the core promoter region defines a sequence as being a promoter: if the region is absent, the promoter is non-functional. Furthermore, the core promoter region is insufficient to provide full promoter activity. A series of regulatory sequences upstream of the core constitute the remainder of the promoter. The regulatory sequences determine expression level, the spatial and temporal pattern of expression and, for an important subset of promoters, expression under inductive conditions (regulation by external factors such as light, temperature, chemicals, hormones).

A range of naturally-occurring promoters are known to be operative in plants and have been used to drive the expression of heterologous (both foreign and endogenous) genes in plants: for example, the constitutive 35S cauliflower mosaic virus (CaMV) promoter, the ripening-enhanced tomato polygalacturonase promoter (Bird et al., 1988), the E8 promoter (Diekman & Fischer, 1988) and the fruit specific 2A1 promoter (Pear et al., 1989) and many others, e.g., U2 and U5 snRNA promoters from maize, the promoter from alcohol dehydrogenase, the Z4 promoter from a gene encoding the Z4 22 kD zein protein, the Z10 promoter from a gene encoding a 10 kD zein protein, a Z27 promoter from a gene encoding a 27 kD zein protein, the A20 promoter from the gene encoding a 19 kD-zein protein, inducible promoters, such as the light inducible promoter derived from the pea rbcS gene and the actin promoter from rice, e.g., the actin 2 promoter (WO 00/70067); seed specific promoters, such as the phaseolin promoter from beans, may also be used. The nucleotide sequences of this invention can also be expressed under the regulation of promoters that are chemically regulated. This enables the nucleic acid sequence or encoded polypeptide to be synthesized only when the crop plants are treated with the inducing chemicals. Chemical induction of gene expression is detailed in EP 0 332 104 (to Ciba-Geigy) and U.S. Pat. No. 5,614,395. A preferred promoter for chemical induction is the tobacco PR-1a promoter.

Examples of some constitutive promoters which have been described include the rice actin 1 (Wang et al., 1992; U.S. Pat. No. 5,641,876), CaMV 35S (Odell et al., 1985), CaMV 19S (Lawton et al., 1987), nos, Adh, sucrose synthase; and the ubiquitin promoters.

Examples of tissue specific promoters which have been described include the lectin (Vodkin, 1983; Lindstrom et al., 1990) corn alcohol dehydrogenase 1 (Vogel et al., 1989; Dennis et al., 1984), corn light harvesting complex (Simpson, 1986; Bansal et al., 1992), corn heat shock protein (Odell et al., 1985), pea small subunit RuBP carboxylase (Poulsen et al., 1986), Ti plasmid mannopine synthase (Langridge et al., 1989), Ti plasmid nopaline synthase (Langridge et al., 1989), petunia chalcone isomerase (vanTunen et al., 1988), bean glycine rich protein 1 (Keller et al., 1989), truncated CaMV 35s (Odell et al., 1985), potato patatin (Wenzler et al., 1989), root cell (Yamamoto et al., 1990), maize zein (Reina et al., 1990; Kriz et al., 1987; Wandelt et al., 1989; Langridge et al., 1983; Reina et al., 1990), globulin-1 (Belanger et al., 1991), α-tubulin, cab (Sullivan et al., 1989), PEPCase (Hudspeth & Grula, 1989), R gene complex-associated promoters (Chandler et al., 1989), histone, and chalcone synthase promoters (Franken et al., 1991). Tissue specific enhancers are described in Fromm et al. (1989).

Inducible promoters that have been described include the ABA- and turgor-inducible promoters, the promoter of the auxin-binding protein gene (Schwob et al., 1993), the UDP glucose flavonoid glycosyl-transferase gene promoter (Ralston et al., 1988), the MPI proteinase inhibitor promoter (Cordero et al., 1994), and the glyceraldehyde-3-phosphate dehydrogenase gene promoter (Kohler et al., 1995; Quigley et al., 1989; Martinez et al., 1989).

Several other tissue-specific regulated genes and/or promoters have been reported in plants. These include genes encoding the seed storage proteins (such as napin, cruciferin, beta-conglycinin, and phaseolin) zein or oil body proteins (such as oleosin), or genes involved in fatty acid biosynthesis (including acyl carrier protein, stearoyl-ACP desaturase. And fatty acid desaturases (fad 2-1)), and other genes expressed during embryo development (such as Bce4, see, for example, EP 255378 and Kridl et al., 1991). Particularly useful for seed-specific expression is the pea vicilin promoter (Czako et al., 1992). (See also U.S. Pat. No. 5,625,136, herein incorporated by reference.) Other useful promoters for expression in mature leaves are those that are switched on at the onset of senescence, such as the SAG promoter from *Arabidopsis* (Gan et al., 1995).

A class of fruit-specific promoters expressed at or during antithesis through fruit development, at least until the beginning of ripening, is discussed in U.S. Pat. No. 4,943,674. cDNA clones that are preferentially expressed in cotton fiber have been isolated (John et al., 1992). cDNA clones from tomato displaying differential expression during fruit development have been isolated and characterized (Mansson et al., 1985, Slater et al., 1985). The promoter for polygalacturonase gene is active in fruit ripening. The polygalacturonase gene is described in U.S. Pat. Nos. 4,535,060, 4,769,061, 4,801,590, and 5,107,065, which disclosures are incorporated herein by reference.

Other examples of tissue-specific promoters include those that direct expression in leaf cells following damage to the leaf (for example, from chewing insects), in tubers (for example, patatin gene promoter), and in fiber cells (an example of a developmentally-regulated fiber cell protein is E6 (John et al., 1992). The E6 gene is most active in fiber, although low levels of transcripts are found in leaf, ovule and flower.

The tissue-specificity of some "tissue-specific" promoters may not be absolute and may be tested by one skilled in the art using the diphtheria toxin sequence. One can also achieve tissue-specific expression with "leaky" expression by a combination of different tissue-specific promoters (Beals et al., 1997). Other tissue-specific promoters can be isolated by one skilled in the art (see U.S. Pat. No. 5,589,379). Several inducible promoters ("gene switches") have been reported. Many are described in the review by Gatz (1996) and Gatz (1997). These include tetracycline repressor system, Lac repressor system, copper-inducible systems, salicylate-inducible systems (such as the PR1a system), glucocorticoid- (Aoyama et al., 1997) and ecdysome-inducible systems. Also included are the benzene sulphonamide- (U.S. Pat. No. 5,364,780) and alcohol (WO 97/06269 and WO 97/06268) inducible systems and glutathione S-transferase promoters. Other studies have focused on genes inducibly regulated in response to environmental stress or stimuli such as increased salinity. Drought, pathogen and wounding. (Graham et al., 1985; Graham et al., 1985, Smith et al., 1986). Accumulation of metallocarboxypeptidase-inhibitor protein has been reported in leaves of wounded potato plants (Graham et al., 1981). Other plant genes have been reported to be induced methyl jasmonate, elicitors, heat-shock, anaerobic stress, or herbicide safeners.

Regulated expression of the chimeric transacting viral replication protein can be further regulated by other genetic strategies. For example, Cre-mediated gene activation as described by Odell et al. 1990. Thus, a DNA fragment containing 3' regulatory sequence bound by lox sites between the promoter and the replication protein coding sequence that blocks the expression of a chimeric replication gene from the promoter can be removed by Cre-mediated excision and result in the expression of the trans-acting replication gene. In this case, the chimeric Cre gene, the chimeric trans-acting replication gene, or both can be under the control of tissue- and developmental-specific or inducible promoters. An alternate genetic strategy is the use of tRNA suppressor gene. For example, the regulated expression of a tRNA suppressor gene can conditionally control expression of a trans-acting replication protein coding sequence containing an appropriate termination codon as described by Ulmasov et al. 1997. Again, either the chimeric tRNA suppressor gene, the chimeric transacting replication gene, or both can be under the control of tissue- and developmental-specific or inducible promoters.

Frequently it is desirable to have continuous or inducible expression of a DNA sequence throughout the cells of an organism in a tissue-independent manner. For example, increased resistance of a plant to infection by soil- and air-borne-pathogens might be accomplished by genetic manipulation of the plant's genome to comprise a continuous promoter operably linked to a heterologous pathogen-resistance gene such that pathogen-resistance proteins are continuously expressed throughout the plant's tissues.

Alternatively, it might be desirable to inhibit expression of a native DNA sequence within a plant's tissues to achieve a desired phenotype. In this case, such inhibition might be accomplished with transformation of the plant to comprise a constitutive, tissue-independent promoter operably linked to an antisense nucleotide sequence, such that constitutive expression of the antisense sequence produces an RNA transcript that interferes with translation of the mRNA of the native DNA sequence.

To define a minimal promoter region, a DNA segment representing the promoter region is removed from the 5' region of the gene of interest and operably linked to the coding sequence of a marker (reporter) gene by recombinant DNA techniques well known to the art. The reporter gene is operably linked downstream of the promoter, so that transcripts initiating at the promoter proceed through the reporter gene. Reporter genes generally encode proteins which are easily measured, including, but not limited to, chloramphenicol acetyl transferase (CAT), beta-glucuronidase (GUS), green fluorescent protein (GFP), beta-galactosidase (beta-GAL), and luciferase.

The construct containing the reporter gene under the control of the promoter is then introduced into an appropriate cell type by transfection techniques well known to the art. To assay for the reporter protein, cell lysates are prepared and appropriate assays, which are well known in the art, for the reporter protein are performed. For example, if CAT are the reporter gene of choice, the lysates from cells transfected with constructs containing CAT under the control of a promoter under study are mixed with isotopically labeled chloramphenicol and acetyl-coenzyme A (acetyl-CoA). The CAT enzyme transfers the acetyl group from acetyl-CoA to the 2- or 3-position of chloramphenicol. The reaction is monitored by thin-layer chromatography, which separates acetylated chloramphenicol from unreacted material. The reaction products are then visualized by autoradiography.

The level of enzyme activity corresponds to the amount of enzyme that is made, which in turn reveals the level of expression from the promoter of interest. This level of expression can be compared to other promoters to determine the relative strength of the promoter under study. In order to be sure that the level of expression is determined by the promoter, rather than by the stability of the mRNA, the level of the reporter mRNA can be measured directly, such as by Northern blot analysis.

Once activity is detected, mutational and/or deletional analyses may be employed to determine the minimal region and/or sequences required to initiate transcription. Thus, sequences can be deleted at the 5' end of the promoter region and/or at the 3' end of the promoter region, and nucleotide substitutions introduced. These constructs are then introduced to cells and their activity determined.

In one embodiment, the promoter may be a gamma zein promoter, an oleosin ole16 promoter, a globulinI promoter, an actin I promoter, an actin c1 promoter, a sucrose synthetase promoter, an INOPS promoter, an EXM5 promoter, a globulin2 promoter, a b-32, ADPG-pyrophosphorylase promoter, an LtpI promoter, an Ltp2 promoter, an oleosin ole17 promoter, an oleosin ole18 promoter, an actin 2 promoter, a pollen-specific protein promoter, a pollen-specific pectate lyase promoter, an anther-specific protein promoter (Huffman), an anther-specific gene RTS2 promoter, a pollen-specific gene promoter, a tapeturn-specific gene promoter, tapeturn-specific gene RAB24 promoter, a anthranilate synthase alpha subunit promoter, an alpha zein promoter, an anthranilate synthase beta subunit promoter, a dihydrodipicolinate synthase promoter, a ThiI promoter, an alcohol dehydrogenase promoter, a cab binding protein promoter, an H3C4 promoter, a RUBISCO SS starch branching enzyme promoter, an ACCase promoter, an actin3 promoter, an actin7 promoter, a regulatory protein GF14-12 promoter, a ribosomal protein L9 promoter, a cellulose biosynthetic enzyme promoter, an S-adenosyl-L-homocysteine hydrolase promoter, a superoxide dismutase promoter, a C-kinase receptor promoter, a phosphoglycerate mutase promoter, a root-specific RCc3 mRNA promoter, a glucose-6 phosphate isomerase promoter, a pyrophosphate-fructose 6-phosphate1-phosphotransferase promoter, an ubiquitin promoter, a beta-ketoacyl-ACP synthase promoter, a 33 kDa photosystem 11 promoter, an oxygen evolving protein promoter, a 69 kDa vacuolar ATPase subunit promoter, a metallothionein-like protein promoter, a glyceraldehyde-3-phosphate dehydrogenase promoter, an ABA- and ripening-inducible-like protein promoter, a phenylalanine ammonia lyase promoter, an adenosine triphosphatase S-adenosyl-L-homocysteine hydrolase promoter, an a-tubulin promoter, a cab promoter, a PEPCase promoter, an R gene promoter, a lectin promoter, a light harvesting complex promoter, a heat shock protein promoter, a chalcone synthase promoter, a zein promoter, a globulin-1 promoter, an ABA promoter, an auxin-binding protein promoter, a UDP glucose flavonoid glycosyl-transferase gene promoter, an NTI promoter, an actin promoter, an opaque 2 promoter, a b70 promoter, an oleosin promoter, a CaMV 35S promoter, a CaMV 19S promoter, a histone promoter, a turgor-inducible promoter, a pea small subunit RuBP carboxylase promoter, a Ti plasmid mannopine synthase promoter, Ti plasmid nopaline synthase promoter, a petunia chalcone isomerase promoter, a bean glycine rich protein I promoter, a CaMV 35S transcript promoter, a potato patatin promoter, or a S-E9 small subunit RuBP carboxylase promoter.

In addition to promoters, a variety of 5N and 3N transcriptional regulatory sequences are also available for use in the present invention. Transcriptional terminators are responsible for the termination of transcription and correct mRNA polyadenylation. The 3N nontranslated regulatory DNA sequence preferably includes from about 50 to about 1,000, more preferably about 100 to about 1,000, nucleotide base pairs and contains plant transcriptional and translational termination sequences. Appropriate transcriptional terminators and those which are known to function in plants include the CaMV 35S terminator, the tml terminator, the nopaline synthase terminator, the pea rbcS E9 terminator, the terminator for the T7 transcript from the octopine synthase gene of *Agrobacterium tumefaciens*, and the 3N end of the protease inhibitor I or II genes from potato or tomato, although other 3N elements known to those of skill in the art can also be employed. Alternatively, one also could use a gamma coixin, oleosin 3 or other terminator from the genus *Coix*.

Preferred 3' elements include those from the nopaline synthase gene of *Agrobacterium tumefaciens* (Bevan et al., 1983), the terminator for the T7 transcript from the octopine synthase gene of *Agrobacterium tumefaciens*, and the 3' end of the protease inhibitor I or II genes from potato or tomato.

As the DNA sequence between the transcription initiation site and the start of the coding sequence, i.e., the untranslated leader sequence, can influence gene expression, one may also wish to employ a particular leader sequence. Preferred leader sequences are contemplated to include those which include sequences predicted to direct optimum expression of the attached gene, i.e., to include a preferred consensus leader sequence which may increase or maintain mRNA stability and prevent inappropriate initiation of translation. The choice of such sequences will be known to those of skill in the art in light of the present disclosure. Sequences that are derived from genes that are highly expressed in plants will be most preferred.

Other sequences that have been found to enhance gene expression in transgenic plants include intron sequences (e.g., from Adh1, bronze1, actin1, actin 2 (WO 00/760067), or the sucrose synthase intron) and viral leader sequences (e.g., from TMV, MCMV and AMV). For example, a number of non-translated leader sequences derived from viruses are known to enhance expression. Specifically, leader sequences from Tobacco Mosaic Virus (TMV), Maize Chlorotic Mottle Virus (MCMV), and Alfalfa Mosaic Virus (AMV) have been shown to be effective in enhancing expression (e.g., Gallie et al., 1987; Skuzesli et al., 1990). Other leaders known in the art include but are not limited to: Picornavirus leaders, for example, EMCV leader (Encephalomyocarditis 5 noncoding region) (Elroy-Stein et al., 1989); Potyvirus leaders, for example, TEV leader (Tobacco Etch Virus); MDMV leader (Maize Dwarf Mosaic Virus); Human immunoglobuin heavy-chain binding protein (BiP) leader, (Macejak et al., 1991); Untranslated leader from the coat protein mRNA of alfalfa mosaic virus (AMV RNA 4), (Jobling et al., 1987; Tobacco mosaic virus leader (TMV), (Gallie et al., 1989; and Maize Chlorotic Mottle Virus leader (MCMV) (Lommel et al., 1991. See also, Della-Cioppa et al., 1987.

Regulatory elements such as Adh intron 1 (Callis et al., 1987), sucrose synthase intron (Vasil et al., 1989) or TMV omega element (Gallie, et al., 1989), may further be included where desired.

Examples of enhancers include elements from the CaMV 35S promoter, octopine synthase genes (Ellis el al., 1987), the rice actin I gene, the maize alcohol dehydrogenase gene (Callis et al., 1987), the maize shrunken I gene (Vasil et al., 1989), TMV Omega element (Gallie et al., 1989) and promoters from non-plant eukaryotes (e.g. yeast; Ma et al., 1988).

Vectors for use in accordance with the present invention may be constructed to include the ocs enhancer element. This element is first identified as a 16 bp palindromic enhancer from the octopine synthase (ocs) gene of ultilane (Ellis et al., 1987), and is present in at least 10 other promoters (Bouchez et al., 1989). The use of an enhancer element, such as the ocs element and particularly multiple copies of the element, will act to increase the level of transcription from adjacent promoters when applied in the context of monocot transformation.

Ultimately, the most desirable DNA segments for introduction into for example a monocot genome may be homologous genes or gene families which encode a desired trait (e.g., increased yield per acre) and which are introduced under the control of novel promoters or enhancers, etc., or perhaps even homologous or tissue specific (e.g., root-, collar/sheath-, whorl-, stalk-, earshank-, kernel or leaf-specific) promoters or control elements. Indeed, it is envisioned that a particular use of the present invention will be the targeting of a gene in a constitutive manner or a root-specific manner. For example, insect resistant genes may be expressed specifically in the whorl and collar/sheath tissues which are targets for the first and second broods, respectively, of ECB. Likewise, genes encoding proteins with particular activity against rootworm may be targeted directly to root tissues.

Vectors for use in tissue-specific targeting of genes in transgenic plants will typically include tissue-specific promoters and may also include other tissue-specific control elements such as enhancer sequences. Promoters which direct specific or enhanced expression in certain plant tissues will be known to those of skill in the art in light of the present disclosure. These include, for example, the rbcS promoter, specific for green tissue; the ocs, nos and mas promoters which have higher activity in roots or wounded leaf tissue; a truncated (−90 to +8) 35S promoter which directs enhanced expression in roots, an alpha-tubulin gene that directs expression in roots and promoters derived from zein storage protein genes which direct expression in endosperm. It is particularly contemplated that one may advantageously use the 16 bp ocs enhancer element from the octopine synthase (ocs) gene (Ellis et al., 1987; Bouchez et al., 1989), especially when present in multiple copies, to achieve enhanced expression in roots.

Tissue specific expression may be functionally accomplished by introducing a constitutively expressed gene (all tissues) in combination with an antisense gene that is expressed only in those tissues where the gene product is not desired. For example, a gene coding for the crystal toxin protein from *B. thuringiensis* (Bt) may be introduced such that it is expressed in all tissues using the 35S promoter from Cauliflower Mosaic Virus. Expression of an antisense transcript of the Bt gene in a maize kernel, using for example a zein promoter, would prevent accumulation of the Bt protein in seed. Hence the protein encoded by the introduced gene would be present in all tissues except the kernel.

Expression of some genes in transgenic plants will be desired only under specified conditions. For example, it is proposed that expression of certain genes that confer resistance to environmental stress factors such as drought will be desired only under actual stress conditions. It is contemplated that expression of such genes throughout a plants development may have detrimental effects. It is known that a large number of genes exist that respond to the environment. For example, expression of some genes such as rbcS, encoding the small subunit of ribulose bisphosphate carboxylase, is regulated by light as mediated through phytochrome. Other genes are induced by secondary stimuli. For example, synthesis of abscisic acid (ABA) is induced by certain environmental factors, including but not limited to water stress. A number of genes have been shown to be induced by ABA (Skriver and Mundy, 1990). It is also anticipated that expression of genes conferring resistance to insect predation would be desired only under conditions of actual insect infestation. Therefore, for some desired traits inducible expression of genes in transgenic plants will be desired.

Expression of a gene in a transgenic plant will be desired only in a certain time period during the development of the plant. Developmental timing is frequently correlated with tissue specific gene expression. For example, expression of zein storage proteins is initiated in the endosperm about 15 days after pollination.

Additionally, vectors may be constructed and employed in the intracellular targeting of a specific gene product within the cells of a transgenic plant or in directing a protein to the extracellular environment. This will generally be achieved by joining a DNA sequence encoding a transit or signal peptide sequence to the coding sequence of a particular gene. The resultant transit, or signal, peptide will transport the protein to a particular intracellular, or extracellular destination, respectively, and will then be post-translationally removed. Transit or signal peptides act by facilitating the transport of proteins through intracellular membranes, e.g., vacuole, vesicle, plastid and mitochondrial membranes, whereas signal peptides direct proteins through the extracellular membrane.

A particular example of such a use concerns the direction of a herbicide resistance gene, such as the EPSPS gene, to a particular organelle such as the chloroplast rather than to the cytoplasm. This is exemplified by the use of the rbcs transit peptide which confers plastid-specific targeting of proteins. In addition, it is proposed that it may be desirable to target certain genes responsible for male sterility to the mitochondria, or to target certain genes for resistance to phytopathogenic organisms to the extracellular spaces, or to target proteins to the vacuole.

By facilitating the transport of the protein into compartments inside and outside the cell, these sequences may increase the accumulation of gene product protecting them from proteolytic degradation. These sequences also allow for additional mRNA sequences from highly expressed genes to be attached to the coding sequence of the genes. Since mRNA being translated by ribosomes is more stable than naked mRNA, the presence of translatable mRNA in front of the gene may increase the overall stability of the mRNA transcript from the gene and thereby increase synthesis of the gene product. Since transit and signal sequences are usually post-translationally removed from the initial translation product, the use of these sequences allows for the addition of extra translated sequences that may not appear on the final polypeptide. Targeting of certain proteins may be desirable in order to enhance the stability of the protein (U.S. Pat. No. 5,545,818).

It may be useful to target DNA itself within a cell. For example, it may be useful to target introduced DNA to the nucleus as this may increase the frequency of transformation. Within the nucleus itself it would be useful to target a gene in order to achieve site specific integration. For example, it would be useful to have an gene introduced through transformation replace an existing gene in the cell.

Other elements include those that can be regulated by endogenous or exogenous agents, e.g., by zinc finger proteins, including naturally occurring zinc finger proteins or chimeric zinc finger proteins (see, e.g., U.S. Pat. No. 5,789,538, WO 99/48909; WO 99/45132; WO 98/53060; WO 98/53057; WO 98/53058; WO 00/23464; WO 95/19431; and WO 98/54311) or myb-like transcription factors. For example, a chimeric zinc finger protein may include amino acid sequences which bind to a specific DNA sequence (the zinc finger) and amino acid sequences that activate (e.g., GAL 4 sequences) or repress the transcription of the sequences linked to the specific DNA sequence.

Of particular interest to the invention is use of an engineered transcription factor such as a zinc finger protein to increase the constitutive expression of a $DIS^R$ gene(s) or to increase expression of a $DIS^R$ gene(s) in an inducible manner. See, for example, WO 01/52620 entitled "Methods And Compositions To Modulate Expression In Plants").

The invention relates to an isolated plant, e.g., *Arabidopsis* and rice, nucleic acid molecule comprising a gene having an open reading frame, the expression of which is altered in response to pathogen infection, as well as the endogenous plant promoters for those genes. However, the expression of these genes may also be altered in response to non-pathogens, e.g., in response to environmental stimuli. The nucleic acid molecules can be used in pathogen control strategies, e.g., by overexpressing nucleic acid molecules which can confer tolerance to a cell, or by altering the expression of host genes which are required for pathogen infection, e.g., by "Knocking out" the expression of at least one genomic copy of the gene. Plants having genetic disruptions in host genes may be less susceptible to infection, e.g., due to a decrease or absence of a host protein needed for infection, or, alternatively, hypersusceptible to infection. Plants that are hypersusceptible to infection may be useful to prepare transgenic plants as the expression of the gene(s) which is disrupted may be related to gene silencing.

Preferred sources from which the nucleic acid molecules of the invention can be obtained or isolated include, but are not limited to, corn (*Zea mays*), *Brassica* sp. (e.g., *B. napus, B. rapa, B. juncea*), particularly those *Brassica* species useful as sources of seed oil, alfalfa (*Medicago sativa*), rice (*Oryza sativa*), rye (*Secale cereale*), sorghum (*Sorghum bicolor, Sorghum vulgare*), millet (e.g., pearl millet (*Pennisetum glaucum*), proso millet (*Panicum miliaceum*), foxtail millet (*Setaria italica*), finger millet (*Eleusine coracana*)), sunflower (*Helianthus annuus*), safflower (*Carthamus tinctorius*), wheat (*Triticum aestivum*), soybean (*Glycine max*), tobacco (*Nicotiana tabacum*), potato (*Solanum tuberosum*), peanuts (*Arachis hypogaea*), cotton (*Gossypium barbadense, Gossypium hirsutum*), sweet potato (*Ipomoea batatus*), cassava (*Manihot esculenta*), coffee (*Cofea* spp.), coconut (*Cocos nucifera*), pineapple (*Ananas comosus*), citrus trees (*Citrus* spp.), cocoa (*Theobroma cacao*), tea (*Camellia sinensis*), banana (*Musa* spp.), avocado (*Persea ultilane*), fig (*Ficus casica*), guava (*Psidium guajava*), mango (*Mangifera indica*), olive (*Olea europaea*), papaya (*Carica papaya*), cashew (*Anacardium occidentale*), macadamia (*Macadamia integrifolia*), almond (*Prunus amygdalus*), sugar beets (*Beta vulgaris*), sugarcane (*Saccharum* spp.), oats, duckweed (*Lemna*), barley, vegetables, ornamentals, and conifers.

Duckweed (*Lemna*, see WO 00/07210) includes members of the family Lemnaceae. There are known four genera and 34 species of duckweed as follows: genus *Lemna* (*L. aequinoctialis, L. disperma, L. ecuadoriensis, L. gibba, L. japonica, L. minor, L. miniscula, L. obscura, L. perpusilla, L. tenera, L. trisulca, L. turionifera, L. valdiviana*); genus *Spirodela* (*S. intermedia, S. polyrrhiza, S. punctata*); genus *Woffia* (*Wa. Angusta, Wa. Arrhiza, Wa. Australina, Wa. Borealis, Wa. Brasiliensis, Wa. Columbiana, Wa. Elongata, Wa. Globosa, Wa. Microscopica, Wa. Neglecta*) and genus *Wofiella* (*Wl. ultila, Wl. ultilane n, Wl. gladiata, Wl. ultila, Wl. lingulata, Wl. repunda, Wl. rotunda,* and *Wl. neotropica*). Any other genera or species of Lemnaceae, if they exist, are also aspects of the present invention. *Lemna gibba, Lemna minor,* and *Lemna miniscula* are preferred, with *Lemna minor* and *Lemna miniscula* being most preferred. *Lemna* species can be classified using the taxonomic scheme described by Landolt, Biosystematic Investigation on the Family of Duckweeds: The family of Lemnaceae—A Monograph Study. Geobatanischen Institut ETH, Stiftung Rubel, Zurich (1986)).

Vegetables from which to obtain or isolate the nucleic acid molecules of the invention include, but are not limited to, tomatoes (*Lycopersicon esculentum*), lettuce (e.g., *Lactuca sativa*), green beans (*Phaseolus vulgaris*), lima beans (*Phaseolus limensis*), peas (*Lathyrus* spp.), and members of the genus *Cucumis* such as cucumber (*C. sativus*), cantaloupe (*C. cantalupensis*), and musk melon (*C. melo*). Ornamentals from which to obtain or isolate the nucleic acid molecules of the invention include, but are not limited to, azalea (*Rhododendron* spp.), hydrangea (*Macrophylla hydrangea*), hibiscus (*Hibiscus rosasanensis*), roses (*Rosa* spp.), tulips (*Tulipa* spp.), daffodils (*Narcissus* spp.), petunias (*Petunia hybrida*), carnation (*Dianthus caryophyllus*), poinsettia (*Euphorbia pulcherrima*), and chrysanthemum. Conifers that may be employed in practicing the present invention include, for example, pines such as loblolly pine (*Pinus taeda*), slash pine (*Pinus elliotii*), ponderosa pine (*Pinus ponderosa*), lodgepole pine (*Pinus contorta*), and Monterey pine (*Pinus radiata*), Douglas-fir (*Pseudotsuga menziesii*); Western hemlock (*Tsuga ultilane*); Sitka spruce (*Picea glauca*); redwood (*Sequoia sempervirens*); true firs such as silver fir (*Abies amabilis*) and balsam fir (*Abies balsamea*); and cedars such as Western red cedar (*Thuja plicata*) and Alaska yellow-cedar (*Chamaecyparis nootkatensis*). Leguminous plants from which the nucleic acid molecules of the invention can be isolated or obtained include, but are not limited to, beans and peas. Beans include guar, locust bean, fenugreek, soybean, garden beans, cowpea, mungbean, lima bean, fava bean, lentils, chickpea, and the like. Legumes include, but are not limited to, *Arachis*, e.g., peanuts, *Vicia*, e.g., crown vetch, hairy vetch, adzuki bean, mung bean, and chickpea, *Lupinus*, e.g., lupine, trifoblium, *Phaseolus*, e.g., common bean and lima bean, *Pisum*, e.g., field bean, *Melilotus*, e.g., clover, *Medicago*, e.g., alfalfa, *Lotus*, e.g., trefoil, lens, e.g., lentil, and false indigo.

Papaya, garlic, pea, peach, pepper, petunia, strawberry, sorghum, sweet potato, turnip, safflower, corn, pea, endive, gourd, grape, snap bean, chicory, cotton, tobacco, aubergine, beet, buckwheat, broad bean, nectarine, avocado, mango, banana, groundnut, potato, peanut, lettuce, pineapple, spinach, squash, sugarbeet, sugarcane, sweet corn, chrysanthemum.

Other preferred sources of the nucleic acid molecules of the invention include *Acacia*, aneth, artichoke, arugula, blackberry, canola, cilantro, clementines, escarole, eucalyptus, fennel, grapefruit, honey dew, jicama, kiwifruit, lemon, lime, mushroom, nut, okra, orange, parsley, persimmon, plantain, pomegranate, poplar, radiata pine, radicchio, Southern pine, sweetgum, tangerine, triticale, vine, yams, apple, pear, quince, cherry, apricot, melon, hemp, buckwheat, grape, raspberry, chenopodium, blueberry, nectarine, peach, plum, strawberry, watermelon, eggplant, pepper, cauliflower, Brassica, e.g., broccoli, cabbage, ultilan sprouts, onion, carrot, leek, beet, broad bean, celery, radish, pumpkin, endive, gourd, garlic, snapbean, spinach, squash, turnip, ultilane, and zucchini.

Yet other sources of nucleic acid molecules are ornamental plants including, but not limited to, impatiens, Begonia, Pelargonium, Viola, Cyclamen, Verbena, Vinca, Tagetes, Primula, Saint Paulia, Agertum, Amaranthus, Antihirrhinum, Aquilegia, Cineraria, Clover, Cosmo, Cowpea, Dahlia, Datura, Delphinium, Gerbera, Gladiolus, Gloxinia, Hippeastrum, Mesembryanthemum, Salpiglossos, and Zinnia.

Other vegetable sources (and databases to identify orthologs of the invention) for the nucleic acid sequences of the invention include Cucurbitaceae, e.g., *Cucumis sativus, Cucumis melo, Citrullus lanatus, Cucurbita pepo, Cucurbita maxima,* and *Cucurbita moschata*; Solanaceae, e.g., *Lycopersicon esculentum, Capsicum annuum, Capsicum frutescens, Solanum melongena, Nicotiana tabacum, Solanum tuberosum,* Petuniaxhybrida hort, ex E. Vilm. (see, 15×BAC on variety Heinz 1706 order from Clemson Genome center, 11.6× BAC of *L. cheesmanii* (originates from J. Giovannoni) available from Clemson genome center, EST collection from TIGR, EST collection from Clemson Genome Center, esculentumxpennelli peruvianum, potatoxtomato, potato and tomato, esculentumxpennelli isozyme and cDNAs, 4× BAC of Petunia hybrida 7984 available from Clemson genome center; Brassicaceae, e.g., *Brassica oleracea* L. var, *italica, Brassica oleracea* L. var, *capitata, Brassica rapa, Brassica oleracea* L. var, *botrytis, Raphanus sativus* var, *niger,* and *Brassica napus* (see, 12× and 6× BACs on Columbia strain available from Clemson genome center; Umbelliferae, e.g., *Daucus carota,* Compositae, e.g., *Lactuca sativa,* and *Helianthus annuus*; Chenopodiaceae, e.g., *Spinacia oleracea* and *Beta vulgaris*; Leguminosae, e.g., *Phaseolus vulgaris, Pisum sativum,* and *Glycine max* (see, 4.3× BAC available from Clemson genome center, 7.5× and 7.9× BACs available from Clemson genome center; Gramineae, e.g., *Zea mays,* see, Novartis BACs for Mo17 and B73 have been donated to Clemson Genome Center; or Liliaceae, e.g., *Allium cepa*.

Preferred forage and turf grass nucleic acid sources for the nucleic acid molecules of the invention include, but are not limited to, alfalfa, orchard grass, tall fescue, perennial ryegrass, creeping bent grass, and redtop. Yet other preferred sources include, but are not limited to, crop plants and in particular cereals (for example, corn, alfalfa, sunflower, rice, Brassica, canola, soybean, barley, soybean, sugarbeet, cotton, safflower, peanut, sorghum, oat, rye, rape, wheat, millet, tobacco, and the like), and even more preferably corn, rice and soybean.

According to one embodiment, the present invention is directed to a nucleic acid molecule comprising a nucleotide sequence isolated or obtained from any plant which encodes a polypeptide having at least 70% amino acid sequence identity to a polypeptide encoded by a gene comprising any one of the DIS$^R$ sequences disclosed herein. Based on the *Arabidopsis* and rice nucleic acid sequences of the present invention, orthologs may be identified or isolated from the genome of any desired organism, preferably from another plant, according to well known techniques based on their sequence similarity to the *Arabidopsis* and rice nucleic acid sequences, e.g., hybridization, PCR or computer generated sequence comparisons. For example, all or a portion of a particular *Arabidopsis* and rice nucleic acid sequence is used as a probe that selectively hybridizes to other gene sequences present in a population of cloned genomic DNA fragments or cDNA fragments (i.e., genomic or cDNA libraries) from a chosen source organism. Further, suitable genomic and cDNA libraries may be prepared from any cell or tissue of an organism. Such techniques include hybridization screening of plated DNA libraries (either plaques or colonies; see, e.g., Sambrook et al., 1989) and amplification by PCR using oligonucleotide primers preferably corresponding to sequence domains conserved among related polypeptide or subsequences of the nucleotide sequences provided herein (see, e.g., Innis et al., 1990). These methods are particularly well suited to the isolation of gene sequences from organisms closely related to the organism from which the probe sequence is derived. The application of these methods using the *Arabidopsis* and rice sequences as probes is well suited for the isolation of gene sequences from any source organism, preferably other plant species. In a PCR approach, oligonucleotide primers can be designed for use in PCR reactions to amplify corresponding DNA sequences from cDNA or genomic DNA extracted from any plant of interest. Methods for designing PCR primers and PCR cloning are generally known in the art.

In hybridization techniques, all or part of a known nucleotide sequence is used as a probe that selectively hybridizes to other corresponding nucleotide sequences present in a population of cloned genomic DNA fragments or cDNA fragments (i.e., genomic or cDNA libraries) from a chosen organism. The hybridization probes may be genomic DNA fragments, cDNA fragments, RNA fragments, or other oligonucleotides, and may be labeled with a detectable group such as $^{32}$P, or any other detectable marker. Thus, for example, probes for hybridization can be made by labeling synthetic oligonucleotides based on the sequence of the invention. Methods for preparation of probes for hybridization and for construction of cDNA and genomic libraries are generally known in the art and are disclosed in Sambrook et al. (1989). In general, sequences that hybridize to the sequences disclosed herein will have at least 40% to 50%, about 60% to 70% and even about 80% 85%, 90%, 95% to 98% or more identity with the disclosed sequences. That is, the sequence similarity of sequences may range, sharing at least about 40% to 50%, about 60% to 70%, and even about 80%, 85%, 90%, 95% to 98% sequence similarity.

The nucleic acid molecules of the invention can also be identified by, for example, a search of known databases for genes encoding polypeptides having a specified amino acid sequence identity or DNA having a specified nucleotide sequence identity. Methods of alignment of sequences for comparison are well known in the art and are described hereinabove.

It is specifically contemplated by the inventors that one could mutagenize DNA having a promoter or open reading frame to, for example, potentially improve the utility of the DNA for expression of transgenes in plants. The mutagenesis can be carried out at random and the mutagenized sequences screened for activity in a trial-by-error procedure. Alternatively, particular sequences which provide the promoter with desirable expression characteristics, or a promoter with expression enhancement activity, could be identified and these or similar sequences introduced into the sequences via mutation. It is further contemplated that one could mutagenize these sequences in order to enhance their expression of transgenes in a particular species.

The means for mutagenizing a DNA segment of the current invention are well-known to those of skill in the art. As indicated, modifications may be made by random or site-specific mutagenesis procedures. The DNA may be modified by altering its structure through the addition or deletion of one or more nucleotides from the sequence which encodes the corresponding un-modified sequences.

Mutagenesis may be performed in accordance with any of the techniques known in the art, such as, and not limited to, synthesizing an oligonucleotide having one or more mutations within the sequence of a particular regulatory region. In particular, site-specific mutagenesis is a technique useful in the preparation of promoter mutants, through specific mutagenesis of the underlying DNA. The technique further provides a ready ability to prepare and test sequence variants, for example, incorporating one or more of the foregoing considerations, by introducing one or more nucleotide sequence changes into the DNA. Site-specific mutagenesis allows the production of mutants through the use of specific oligonucleotide sequences which encode the DNA sequence of the desired mutation, as well as a sufficient number of adjacent nucleotides, to provide a primer sequence of sufficient size and sequence complexity to form a stable duplex on both sides of the deletion junction being traversed. Typically, a primer of about 17 to about 75 nucleotides or more in length is preferred, with about 10 to about 25 or more residues on both sides of the junction of the sequence being altered.

In general, the technique of site-specific mutagenesis is well known in the art, as exemplified by various publications. As will be appreciated, the technique typically employs a phage vector which exists in both a single stranded and double stranded form. Typical vectors useful in site-directed mutagenesis include vectors such as the M13 phage. These phage are readily commercially available and their use is generally well known to those skilled in the art.

Double stranded plasmids also are routinely employed in site directed mutagenesis which eliminates the step of transferring the gene of interest from a plasmid to a phage.

In general, site-directed mutagenesis in accordance herewith is performed by first obtaining a single-stranded vector or melting apart of two strands of a double stranded vector which includes within its sequence a DNA sequence which encodes the promoter. An oligonucleotide primer bearing the desired mutated sequence is prepared, generally synthetically. This primer is then annealed with the single-stranded vector, and subjected to DNA polymerizing enzymes such as *E. coli* polymerase I Klenow fragment, in order to complete the synthesis of the mutation-bearing stand. Thus, a heteroduplex is formed wherein one strand encodes the original non-mutated sequence and the second strand bears the desired mutation.

This heteroduplex vector is then used to transform or transfect appropriate cells, such as *E. coli* cells, and cells are selected which include recombinant vectors bearing the mutated sequence arrangement. Vector DNA can then be isolated from these cells and used for plant transformation. A genetic selection scheme is devised by Kunkel et al. (1987) to enrich for clones incorporating mutagenic oligonucleotides. Alternatively, the use of PCR with commercially available thermostable enzymes such as Taq polymerase may be used to incorporate a mutagenic oligonucleotide primer into an amplified DNA fragment that can then be cloned into an appropriate cloning or expression vector. The PCR-mediated mutagenesis procedures of Tomic et al. (1990) and Upender et al. (1995) provide two examples of such protocols. A PCR employing a thermostable ligase in addition to a thermostable polymerase also may be used to incorporate a phosphorylated mutagenic oligonucleotide into an amplified DNA fragment that may then be cloned into an appropriate cloning or expression vector. The mutagenesis procedure described by Michael (1994) provides an example of one such protocol.

The preparation of sequence variants of DNA segments using site-directed mutagenesis is provided as a means of producing potentially useful species and is not meant to be limiting as there are other ways in which sequence variants of DNA sequences may be obtained. For example, recombinant vectors encoding the desired promoter sequence may be treated with mutagenic agents, such as hydroxylamine, to obtain sequence variants.

In addition, an unmodified or modified nucleotide sequence of the present invention can be varied by shuffling the sequence of the invention. To test for a function of variant DNA sequences according to the invention, the sequence of interest is operably linked to a selectable or screenable marker gene and expression of the marker gene is tested in transient expression assays with protoplasts or in stably transformed plants. It is known to the skilled artisan that DNA sequences capable of driving expression of an associated nucleotide sequence are build in a modular way. Accordingly, expression levels from shorter DNA fragments may be different than the one from the longest fragment and may be different from each other. For example, deletion of a down-regulating upstream element will lead to an increase in the expression levels of the associated nucleotide sequence while deletion of an up-regulating element will decrease the expression levels of the associated nucleotide sequence. It is also known to the skilled artisan that deletion of development-specific or a tissue-specific element will lead to a temporally or spatially altered expression profile of the associated nucleotide sequence.

As used herein, the term "oligonucleotide directed mutagenesis procedure" refers to template-dependent processes and vector-mediated propagation which result in an increase in the concentration of a specific nucleic acid molecule relative to its initial concentration, or in an increase in the concentration of a detectable signal, such as amplification. As used herein, the term "oligonucleotide directed mutagenesis procedure" also is intended to refer to a process that involves the template-dependent extension of a primer molecule. The term template-dependent process refers to nucleic acid synthesis of an RNA or a DNA molecule wherein the sequence of the newly synthesized strand of nucleic acid is dictated by the well-known rules of complementary base pairing (see, for example, Watson and Rarnstad, 1987). Typically, vector mediated methodologies involve the introduction of the nucleic acid fragment into a DNA or RNA vector, the clonal amplification of the vector, and the recovery of the amplified nucleic acid fragment. Examples of such methodologies are provided by U.S. Pat. No. 4,237,224. A number of template dependent processes are available to amplify the target sequences of interest present in a sample, such methods being well known in the art and specifically disclosed herein below.

Where a clone comprising a promoter has been isolated in accordance with the instant invention, one may wish to delimit the essential promoter regions within the clone. One efficient, targeted means for preparing mutagenizing promoters relies upon the identification of putative regulatory elements within the promoter sequence. This can be initiated by comparison with promoter sequences known to be expressed in similar tissue-specific or developmentally unique manner. Sequences which are shared among promoters with similar expression patterns are likely candidates for the binding of transcription factors and are thus likely elements which confer expression patterns. Confirmation of these putative regulatory elements can be achieved by deletion analysis of each putative regulatory region followed by functional analysis of each deletion construct by assay of a reporter gene which is functionally attached to each construct. As such, once a starting promoter sequence is provided, any of a number of different deletion mutants of the starting promoter could be readily prepared.

As indicated above, deletion mutants, deletion mutants of the promoter of the invention also could be randomly prepared and then assayed. With this strategy, a series of constructs are prepared, each containing a different portion of the clone (a subclone), and these constructs are then screened for activity. A suitable means for screening for activity is to attach a deleted promoter or intron construct which contains a deleted segment to a selectable or screenable marker, and to isolate only those cells expressing the marker gene. In this way, a number of different, deleted promoter constructs are identified which still retain the desired, or even enhanced, activity. The smallest segment which is required for activity is thereby identified through comparison of the selected constructs. This segment may then be used for the construction of vectors for the expression of exogenous genes.

In order to improve the ability to identify transformants, one may desire to employ a selectable or screenable marker gene as, or in addition to, the expressible gene of interest. "Marker genes" are genes that impart a distinct phenotype to cells expressing the marker gene and thus allow such transformed cells to be distinguished from cells that do not have the marker. Such genes may encode either a selectable or screenable marker, depending on whether the marker confers a trait which one can 'select' for by chemical means, i.e., through the use of a selective agent (e.g., a herbicide, antibiotic, or the like), or whether it is simply a trait that one can identify through observation or testing, i.e., by 'screening' (e.g., the R-locus trait, the green fluorescent protein (GFP)). Of course, many examples of suitable marker genes are known to the art and can be employed in the practice of the invention.

Included within the terms selectable or screenable marker genes are also genes which encode a "secretable marker" whose secretion can be detected as a means of identifying or selecting for transformed cells. Examples include markers which encode a secretable antigen that can be identified by antibody interaction, or even secretable enzymes which can be detected by their catalytic activity. Secretable proteins fall into a number of classes, including small, diffusible proteins detectable, e.g., by ELISA; small active enzymes detectable in extracellular solution (e.g., alpha-amylase, beta-lactamase, phosphinothricin acetyltransferase); and proteins that are inserted or trapped in the cell wall (e.g., proteins that include a leader sequence such as that found in the expression unit of extension or tobacco PR-S).

With regard to selectable secretable markers, the use of a gene that encodes a protein that becomes sequestered in the cell wall, and which protein includes a unique epitope is considered to be particularly advantageous. Such a secreted antigen marker would ideally employ an epitope sequence that would provide low background in plant tissue, a promoter-leader sequence that would impart efficient expression and targeting across the plasma membrane, and would produce protein that is bound in the cell wall and yet accessible to antibodies. A normally secreted wall protein modified to include a unique epitope would satisfy all such requirements.

One example of a protein suitable for modification in this manner is extension, or hydroxyproline rich glycoprotein (HPRG). For example, the maize HPRG (Steifel et al., 1990) molecule is well characterized in terms of molecular biology, expression and protein structure. However, any one of a variety of ultilane and/or glycine-rich wall proteins (Keller et al., 1989) could be modified by the addition of an antigenic site to create a screenable marker.

One exemplary embodiment of a secretable screenable marker concerns the use of a maize sequence encoding the wall protein HPRG, modified to include a 15 residue epitope from the pro-region of murine interleukin, however, virtually any detectable epitope may be employed in such embodiments, as selected from the extremely wide variety of antigen-antibody combinations known to those of skill in the art. The unique extracellular epitope can then be straightforwardly detected using antibody labeling in conjunction with chromogenic or fluorescent adjuncts.

Elements of the present disclosure may be exemplified in detail through the use of the bar and/or GUS genes, and also through the use of various other markers. Of course, in light of this disclosure, numerous other possible selectable and/or screenable marker genes will be apparent to those of skill in the art in addition to the one set forth hereinbelow. Therefore, it will be understood that the following discussion is exemplary rather than exhaustive. In light of the techniques disclosed herein and the general recombinant techniques which are known in the art, the present invention renders possible the introduction of any gene, including marker genes, into a recipient cell to generate a transformed plant. Possible selectable markers for use in connection with the present invention include, but are not limited to, a neo gene which codes for kanamycin resistance and can be selected for using kanamycin, G418, paromomycin, and the like; a bar gene which codes for bialaphos or phosphinothricin resistance; a gene which encodes an altered EPSP synthase protein (Hinchee et al., 1988) thus conferring glyphosate resistance; a nitrilase gene such as bxn from *Klebsiella ozaenae* which confers resistance to bromoxynil (Stalker et al., 1988); a mutant acetolactate synthase gene (ALS) which confers resistance to imidazolinone, sulfonylurea or other ALS-inhibiting chemicals (European Patent Application 154,204, 1985); a methotrexate-resistant DHFR gene (Thillet et al., 1988); a dalapon dehalogenase gene that confers resistance to the herbicide dalapon; a mutated anthranilate synthase gene that confers resistance to 5-methyl tryptophan. Preferred selectable marker genes encode phosphinothricin acetyltransferase; glyphosate resistant EPSPS, aminoglycoside phosphotransferase; hygromycin phosphotransferase, or neomycin phosphotransferase. Where a mutant EPSP synthase gene is employed, additional benefit may be realized through the incorporation of a suitable chloroplast transit peptide, CTP (European Patent Application 0,218,571, 1987).

An illustrative embodiment of a selectable marker gene capable of being used in systems to select transformants is the genes that encode the enzyme phosphinothricin acetyltransferase, such as the bar gene from *Streptomyces hygroscopicus* or the pat gene from *Streptomyces viridochromogenes*. The enzyme phosphinothricin acetyl transferase (PAT) inactivates the active ingredient in the herbicide bialaphos, phosphinothricin (PPT). PPT inhibits glutamine synthetase, (Murakami et al., 1986; Twell et al., 1989) causing rapid accumulation of ammonia and cell death. The success in using this selective system in conjunction with monocots is particularly surprising because of the major difficulties which have been reported in transformation of cereals.

Where one desires to employ a bialaphos resistance gene in the practice of the invention, a particularly useful gene for this purpose is the bar or pat genes obtainable from species of *Streptomyces* (e.g., ATCC No. 21,705). The cloning of the bar gene has been described (Murakami et al., 1986; Thompson et al., 1987) as has the use of the bar gene in the context of plants other than monocots (De Block et al., 1987; De Block et al., 1989).

Selection markers resulting in positive selection, such as a phosphomannose isomerase gene, as described in patent application WO 93/05163, may also be used. Alternative genes to be used for positive selection are described in WO 94/20627 and encode xyloisomerases and phosphomanno-isomerases such as mannose-6-phosphate isomerase and mannose-1-phosphate isomerase; phosphomanno mutase; mannose epimerases such as those which convert carbohydrates to mannose or mannose to carbohydrates such as glucose or galactose; phosphatases such as mannose or xylose phosphatase, mannose-6-phosphatase and mannose-1-phosphatase, and permeases which are involved in the transport of mannose, or a derivative, or a precursor thereof into the cell. Transformed cells are identified without damaging or killing the non-transformed cells in the population and without co-introduction of antibiotic or herbicide resistance genes. As described in WO 93/05163, in addition to the fact that the need for antibiotic or herbicide resistance genes is eliminated, it has been shown that the positive selection method is often far more efficient than traditional negative selection.

Screenable markers that may be employed include, but are not limited to, a beta-glucuronidase (GUS) or uidA gene which encodes an enzyme for which various chromogenic substrates are known; an R-locus gene, which encodes a product that regulates the production of anthocyanin pigments (red color) in plant tissues (Dellaporta et al., 1988); a beta-lactamase gene (Sutcliffe, 1978), which encodes an enzyme for which various chromogenic substrates are known (e.g., PADAC, a chromogenic cephalosporin); a xylE gene (Zukowsky et al., 1983) which encodes a catechol dioxygenase that can convert chromogenic catechols; an ∀-amylase gene (Ikuta et al., 1990); a tyrosinase gene (Katz et al., 1983) which encodes an enzyme capable of oxidizing tyrosine to DOPA and dopaquinone which in turn condenses to form the easily detectable compound melanin; a ∃-galactosidase gene, which encodes an enzyme for which there are chromogenic substrates; a luciferase (lux) gene (Ow et al., 1986), which allows for bioluminescence detection; or even an acquorin gene (Prasher et al., 1985), which may be employed in calcium-sensitive bioluminescence detection, or a green fluorescent protein gene (Niedz et al., 1995).

Genes from the maize R gene complex are contemplated to be particularly useful as screenable markers. The R gene complex in maize encodes a protein that acts to regulate the production of anthocyanin pigments in most seed and plant tissue. A gene from the R gene complex is applied to maize transformation, because the expression of this gene in transformed cells does not harm the cells. Thus, an R gene introduced into such cells will cause the expression of a red pigment and, if stably incorporated, can be visually scored as a red sector. If a maize line carries dominant allele for genes encoding the enzymatic intermediates in the anthocyanin biosynthetic pathway (C2, A1, A2, Bz1 and Bz2) (Roth et al., 1990), but carries a recessive allele at the R locus, transformation of any cell from that line with R will result in red pigment formation. Exemplary lines include Wisconsin 22 which contains the rg-Stadler allele and TR112, a K55 derivative which is r-g, b, P1. Alternatively any genotype of maize can be utilized if the C1 and R alleles are introduced together.

It is further proposed that R gene regulatory regions may be employed in chimeric constructs in order to provide mechanisms for controlling the expression of chimeric genes. More diversity of phenotypic expression is known at the R locus than at any other locus (Coe et al., 1988). It is contemplated that regulatory regions obtained from regions 5' to the structural R gene would be valuable in directing the expression of genes, e.g., insect resistance, drought resistance, herbicide tolerance or other protein coding regions. For the purposes of the present invention, it is believed that any of the various R gene family members may be successfully employed (e.g., P, S, Lc, etc.). However, the most preferred will generally be Sn (particularly Sn:bol3). Sn is a dominant member of the R gene complex and is functionally similar to the R and B loci in that Sn controls the tissue specific deposition of anthocyanin pigments in certain seedling and plant cells, therefore, its phenotype is similar to R.

A further screenable marker contemplated for use in the present invention is firefly luciferase, encoded by the lux gene. The presence of the lux gene in transformed cells may be detected using, for example, X-ray film, scintillation counting, fluorescent spectrophotometry, low-light video cameras, photon counting cameras or multiwell luminometry. It is also envisioned that this system may be developed for populational screening for bioluminescence, such as on tissue culture plates, or even for whole plant screening. Where use of a screenable marker gene such as lux or GFP is desired, benefit may be realized by creating a gene fusion between the screenable marker gene and a selectable marker gene, for example, a GFP-NPTII gene fusion. This could allow, for example, selection of transformed cells followed by screening of transgenic plants or seeds.

One skilled in the art recognizes that the expression level and regulation of a transgene in a plant can vary significantly from line to line. Thus, one has to test several lines to find one with the desired expression level and regulation. Once a line is identified with the desired regulation specificity, it can be crossed with lines carrying different inactive replicons or inactive transgene for activation.

Other sequences which may be linked to the gene of interest which encodes a polypeptide are those which can target to a specific organelle, e.g., to the mitochondria, nucleus, or plastid, within the plant cell. Targeting can be achieved by providing the polypeptide with an appropriate targeting peptide sequence, such as a secretory signal peptide (for secretion or cell wall or membrane targeting, a plastid transit peptide, a chloroplast transit peptide, e.g., the chlorophyll a/b binding protein, a mitochondrial target peptide, a vacuole targeting peptide, or a nuclear targeting peptide, and the like. For example, the small subunit of ribulose bisphosphate carboxylase transit peptide, the EPSPS transit peptide or the dihydrodipicolinic acid synthase transit peptide may be used. For examples of plastid organelle targeting sequences (see WO 00/12732). Plastids are a class of plant organelles derived from proplastids and include chloroplasts, leucoplasts, araviloplasts, and chromoplasts. The plastids are major sites of biosynthesis in plants. In addition to photosynthesis in the chloroplast, plastids are also sites of lipid biosynthesis, nitrate reduction to ammonium, and starch storage. And while plastids contain their own circular genome, most of the proteins localized to the plastids are encoded by the nuclear genome and are imported into the organelle from the cytoplasm.

Transgenes used with the present invention will often be genes that direct the expression of a particular protein or polypeptide product, but they may also be non-expressible DNA segments, e.g., transposons such as Ds that do no direct their own transposition. As used herein, an "expressible gene" is any gene that is capable of being transcribed into RNA (e.g., mRNA, antisense RNA, etc.) or translated into a protein, expressed as a trait of interest, or the like, etc., and is not limited to selectable, screenable or non selectable marker genes. The invention also contemplates that, where both an expressible gene that is not necessarily a marker gene is employed in combination with a marker gene, one may employ the separate genes on either the same or different DNA segments for transformation. In the latter case, the different vectors are delivered concurrently to recipient cells to maximize cotransformation.

The choice of the particular DNA segments to be delivered to the recipient cells will often depend on the purpose of the transformation. One of the major purposes of transformation of crop plants is to add some commercially desirable, agronomically important traits to the plant. Such traits include, but are not limited to, herbicide resistance or tolerance; insect resistance or tolerance; disease resistance or tolerance (viral, bacterial, fungal, nematode); stress tolerance and/or resistance, as exemplified by resistance or tolerance to drought, heat, chilling, freezing, excessive moisture, salt stress; oxidative stress; increased yields; food content and makeup; physical appearance; male sterility; drydown; standability; prolificacy; starch properties; oil quantity and quality; and the like. One may desire to incorporate one or more genes conferring any such desirable trait or traits, such as, for example, a gene or genes encoding pathogen resistance.

In certain embodiments, the present invention contemplates the transformation of a recipient cell with more than one advantageous transgene. Two or more transgenes can be supplied in a single transformation event using either distinct transgene-encoding vectors, or using a single vector incorporating two or more gene coding sequences. For example, plasmids bearing the bar and aroA expression units in either convergent, divergent, or colinear orientation, are considered to be particularly useful. Further preferred combinations are those of an insect resistance gene, such as a Bt gene, along with a protease inhibitor gene such as pinII, or the use of bar in combination with either of the above genes. Of course, any two or more transgenes of any description, such as those conferring herbicide, insect, disease (viral, bacterial, fungal, nematode) or drought resistance, male sterility, drydown, standability, prolificacy, starch properties, oil quantity and quality, or those increasing yield or nutritional quality may be employed as desired.

The genes encoding phosphinothricin acetyltransferase (bar and pat), glyphosate tolerant EPSP synthase genes, the glyphosate degradative enzyme gene gox encoding glyphosate oxidoreductase, deh (encoding a dehalogenase enzyme that inactivates dalapon), herbicide resistant (e.g., sulfonylurea and imidazolinone) acetolactate synthase, and bxn genes (encoding a nitrilase enzyme that degrades bromoxynil) are good examples of herbicide resistant genes for use in transformation. The bar and pat genes code for an enzyme, phosphinothricin acetyltransferase (PAT), which inactivates the herbicide phosphinothricin and prevents this compound from inhibiting glutamine synthetase enzymes. The enzyme 5-enolpyruvylshikimate 3-phosphate synthase (EPSP Synthase), is normally inhibited by the herbicide N-(phosphonomethyl)glycine (glyphosate). However, genes are known that encode glyphosate-resistant EPSP Synthase enzymes. These genes are particularly contemplated for use in monocot transformation. The deh gene encodes the enzyme dalapon dehalogenase and confers resistance to the herbicide dalapon. The bxn gene codes for a specific nitrilase enzyme that converts bromoxynil to a non-herbicidal degradation product.

An important aspect of the present invention concerns the introduction of insect resistance-conferring genes into plants. The following may be stacked with $DIS^R$ genes of the invention to enhance or broaden disease resistance.

Potential insect resistance genes which can be introduced include *Bacillus thuringiensis* crystal toxin genes or Bt genes (Watrud et al., 1985). Bt genes may provide resistance to lepidopteran or coleopteran pests such as European Corn Borer (ECB) and corn rootworm (CRW). Preferred Bt toxin genes for use in such embodiments include the CryIA(b) and CryIA(c) genes. Endotoxin genes from other species of *B. thuringiensis* which affect insect growth or development may also be employed in this regard.

The poor expression of Bt toxin genes in plants is a well-documented phenomenon, and the use of different promoters, fusion proteins, and leader sequences has not led to significant increases in Bt protein expression (Vaeck et al., 1989; Barton et al., 1987). It is therefore contemplated that the most advantageous Bt genes for use in the transformation protocols disclosed herein will be those in which the coding sequence has been modified to effect increased expression in plants, and more particularly, those in which maize preferred codons have been used. Examples of such modified Bt toxin genes include the variant Bt CryIA(b) gene termed Iab6 (Perlak et al., 1991) and the synthetic CryIA(c) genes termed 1800a and 1800b.

Protease inhibitors may also provide insect resistance (Johnson et al., 1989), and will thus have utility in plant transformation. The use of a protease inhibitor II gene, pinII, from tomato or potato is envisioned to be particularly useful. Even more advantageous is the use of a pinII gene in combination with a Bt toxin gene, the combined effect of which has been discovered by the present inventors to produce synergistic insecticidal activity. Other genes which encode inhibitors of the insects' digestive system, or those that encode enzymes or co-factors that facilitate the production of inhibitors, may also be useful. This group may be exemplified by oryzacystatin and amylase inhibitors, such as those from wheat and barley.

Also, genes encoding lectins may confer additional or alternative insecticide properties. Lectins (originally termed phytohemagglutinins) are multivalent carbohydrate-binding proteins which have the ability to agglutinate red blood cells from a range of species. Lectins have been identified recently as insecticidal agents with activity against weevils, ECB and rootworm (Murdock et al., 1990; Czapla and Lang, 1990). Lectin genes contemplated to be useful include, for example, barley and wheat germ agglutinin (WGA) and rice lectins (Gatehouse et al., 1984), with WGA being preferred.

Genes controlling the production of large or small polypeptides active against insects when introduced into the insect pests, such as, e.g., lytic peptides, peptide hormones and toxins and venoms, form another aspect of the invention. For example, it is contemplated that the expression of juvenile hormone esterase, directed towards specific insect pests, may also result in insecticidal activity, or perhaps cause cessation of metamorphosis (Hammock et al., 1990).

Transgenic plants expressing genes which encode enzymes that affect the integrity of the insect cuticle form yet another aspect of the invention. Such genes include those encoding, e.g., chitinase, proteases, lipases and also genes for the production of nikkomycin, a compound that inhibits chitin synthesis, the introduction of any of which is contemplated to produce insect resistant maize plants. Genes that code for activities that affect insect molting, such those affecting the production of ecdysteroid UDP-glucosyl transferase, also fall within the scope of the useful transgenes of the present invention.

Genes that code for enzymes that facilitate the production of compounds that reduce the nutritional quality of the host plant to insect pests are also encompassed by the present invention. It may be possible, for instance, to confer insecticidal activity on a plant by altering its sterol composition. Sterols are obtained by insects from their diet and are used for hormone synthesis and membrane stability. Therefore alterations in plant sterol composition by expression of novel genes, e.g., those that directly promote the production of undesirable sterols or those that convert desirable sterols into undesirable forms, could have a negative effect on insect growth and/or development and hence endow the plant with insecticidal activity. Lipoxygenases are naturally occurring plant enzymes that have been shown to exhibit anti-nutritional effects on insects and to reduce the nutritional quality of their diet. Therefore, further embodiments of the invention concern transgenic plants with enhanced lipoxygenase activity which may be resistant to insect feeding.

The present invention also provides methods and compositions by which to achieve qualitative or quantitative changes in plant secondary metabolites. One example concerns transforming plants to produce DIMBOA which, it is contemplated, will confer resistance to European corn borer, rootworm and several other maize insect pests. Candidate genes that are particularly considered for use in this regard include those genes at the bx locus known to be involved in the synthetic DIMBOA pathway (Dunn et al., 1981). The introduction of genes that can regulate the production of maysin, and genes involved in the production of dhurrin in sorghum, is also contemplated to be of use in facilitating resistance to earworm and rootworm, respectively.

*Tripsacum dactyloides* is a species of grass that is resistant to certain insects, including corn root worm. It is anticipated that genes encoding proteins that are toxic to insects or are involved in the biosynthesis of compounds toxic to insects will be isolated from *Tripsacum* and that these novel genes will be useful in conferring resistance to insects. It is known that the basis of insect resistance in *Tripsacum* is genetic, because said resistance has been transferred to *Zea mays* via sexual crosses (Branson and Guss, 1972).

Further genes encoding proteins characterized as having potential insecticidal activity may also be used as transgenes in accordance herewith. Such genes include, for example, the cowpea trypsin inhibitor (CPTI; Hilder et al., 1987) which may be used as a rootworm deterrent; genes encoding avermectin (Campbell, 1989; Ikeda et al., 1987) which may prove particularly useful as a corn rootworm deterrent; ribosome inactivating protein genes; and even genes that regulate plant structures. Transgenic maize including anti-insect antibody genes and genes that code for enzymes that can covert a nontoxic insecticide (pro insecticide) applied to the outside of the plant into an insecticide inside the plant are also contemplated.

It is proposed that increased resistance to diseases may be realized through introduction of genes into plants, more specifically the $DIS^R$ genes of the invention. It is possible to produce resistance to diseases caused by viruses, bacteria, fungi, root pathogens, insects and nematodes. It is also contemplated that control of mycotoxin producing organisms may be realized through expression of introduced genes.

Resistance to viruses may be produced through expression of novel genes. For example, it has been demonstrated that expression of a viral coat protein in a transgenic plant can impart resistance to infection of the plant by that virus and perhaps other closely related viruses (Cuozzo et al., 1988, Hemenway et al., 1988, Abel et al., 1986). It is contemplated that expression of antisense genes targeted at essential viral functions may impart resistance to said virus. For example, an antisense gene targeted at the gene responsible for replication of viral nucleic acid may inhibit said replication and lead to resistance to the virus. It is believed that interference with other viral functions through the use of antisense genes may also increase resistance to viruses. Further it is proposed that it may be possible to achieve resistance to viruses through other approaches, including, but not limited to the use of satellite viruses.

It is proposed that increased resistance to diseases caused by bacteria and fungi may be realized through introduction of novel genes. It is contemplated that genes encoding so-called "peptide antibiotics," pathogenesis related (PR) proteins, toxin resistance, and proteins affecting host-pathogen interactions such as morphological characteristics will be useful. Peptide antibiotics are polypeptide sequences which are inhibitory to growth of bacteria and other microorganisms. For example, the classes of peptides referred to as cecropins and magainins inhibit growth of many species of bacteria and fungi. It is proposed that expression of PR proteins in plants may be useful in conferring resistance to bacterial disease. These genes are induced following pathogen attack on a host plant and have been divided into at least five classes of proteins (Bol et al., 1990). Included amongst the PR proteins are beta-1,3-glucanases, chitinases, and osmotin and other proteins that are believed to function in plant resistance to disease organisms. Other genes have been identified that have antifungal properties, e.g., UDA (stinging nettle lectin) and herein (Broakgert et al., 1989; Barkai-Golan et al., 1978). It is known that certain plant diseases are caused by the production of phytotoxins. Resistance to these diseases could be achieved through expression of a novel gene that encodes an enzyme capable of degrading or otherwise inactivating the phytotoxin. Expression novel genes that alter the interactions between the host plant and pathogen may be useful in reducing the ability the disease organism to invade the tissues of the host plant, e.g., an increase in the waxiness of the leaf cuticle or other morphological characteristics.

Plant parasitic nematodes are a cause of disease in many plants. It is proposed that it would be possible to make the plant resistant to these organisms through the expression of novel genes. It is anticipated that control of nematode infestations would be accomplished by altering the ability of the nematode to recognize or attach to a host plant and/or enabling the plant to produce nematicidal compounds, including but not limited to proteins.

4. Mycotoxin Reduction/Elimination

Production of mycotoxins, including aflatoxin and fumonisin, by fungi associated with plants is a significant factor in rendering the grain not useful. These fungal organisms do not cause disease symptoms and/or interfere with the growth of the plant, but they produce chemicals (mycotoxins) that are toxic to animals. Increased tolerance of a plant to fungal infection would reduce the presence of fungi, and thus its toxins and, therefore, reduce grain losses due to mycotoxin contamination. $DIS^R$ genes of the invention may be introduced into plants to achieve this. Overexpression of a $DIS^R$ gene, or overexpression in response to initial pathogen presence or contact, would thus be useful.

Introduction of genes encoding traits that can be selected against may be useful for eliminating undesirable linked genes. When two or more genes are introduced together by cotransformation, the genes will be linked together on the host chromosome. For example, a gene encoding a Bt gene that confers insect resistance on the plant may be introduced into a plant together with a bar gene that is useful as a selectable marker and confers resistance to the herbicide Ignite® on the plant. However, it may not be desirable to have an insect resistant plant that is also resistant to the herbicide Ignite®. It is proposed that one could also introduce an antisense bar gene that is expressed in those tissues where one does not want expression of the bar gene, e.g., in whole plant parts. Hence, although the bar gene is expressed and is useful as a selectable marker, it is not useful to confer herbicide resistance on the whole plant. The bar antisense gene is a negative selectable marker.

Negative selection is necessary in order to screen a population of transformants for rare homologous recombinants generated through gene targeting. For example, a homologous recombinant may be identified through the inactivation of a gene that is previously expressed in that cell. The antisense gene to neomycin phosphotransferase II (nptII) has been investigated as a negative selectable marker in tobacco (*Nicotiana tabacum*) and *Arabidopsis thaliana* (Xiang and Guerra, 1993). In this example both sense and antisense nptII genes are introduced into a plant through transformation and the resultant plants are sensitive to the antibiotic kanamycin. An introduced gene that integrates into the host cell chromosome at the site of the antisense nptII gene, and inactivates the antisense gene, will make the plant resistant to kanamycin and other aminoglycoside antibiotics. Therefore, rare site specific recombinants may be identified by screening for antibiotic resistance. Similarly, any gene, native to the plant or introduced through transformation, that when inactivated confers resistance to a compound, may be useful as a negative selectable marker.

It is contemplated that negative selectable markers may also be useful in other ways. One application is to construct transgenic lines in which one could select for transposition to unlinked sites. In the process of tagging it is most common for the transposable element to move to a genetically linked site on the same chromosome. A selectable marker for recovery of rare plants in which transposition has occurred to an unlinked locus would be useful. For example, the enzyme cytosine deaminase may be useful for this purpose (Stouggard, 1993). In the presence of this enzyme the compound 5-fluorocytosine is converted to 5-fluoruracil which is toxic to plant and animal cells. If a transposable element is linked to the gene for the enzyme cytosine deaminase, one may select for transposition to unlinked sites by selecting for transposition events in which the resultant plant is now resistant to 5-fluorocytosine. The parental plants and plants containing transpositions to linked sites will remain sensitive to 5-fluorocytosine. Resistance to 5-fluorocytosine is due to loss of the cytosine deaminase gene through genetic segregation of the transposable element and the cytosine deaminase gene. Other genes that encode proteins that render the plant sensitive to a certain compound will also be useful in this context. For example, T-DNA gene 2 from *Agrobacterium tumefaciens* encodes a protein that catalyzes the conversion of alpha-naphthalene acetamide (NAM) to alpha-napthalene acetic acid (NAA) renders plant cells sensitive to high concentrations of NAM (Depicker et al., 1988).

It is also contemplated that negative selectable markers may be useful in the construction of transposon tagging lines. For example, by marking an autonomous transposable element such as Ac, Master Mu, or En/Spn with a negative selectable marker, one could select for transformants in which the autonomous element is not stably integrated into the genome. This would be desirable, for example, when transient expression of the autonomous element is desired to activate in trans the transposition of a defective transposable element, such as Ds, but stable integration of the autonomous element is not desired. The presence of the autonomous element may not be desired in order to stabilize the defective element, i.e., prevent it from further transposing. However, it is proposed that if stable integration of an autonomous transposable element is desired in a plant the presence of a negative selectable marker may make it possible to eliminate the autonomous element during the breeding process.

DNA may be introduced into plants for the purpose of expressing RNA transcripts that function to affect plant phenotype yet are not translated into protein. Two examples are antisense RNA and RNA with ribozyme activity. Both may serve possible functions in reducing or eliminating expression of native or introduced plant genes.

Genes may be constructed or isolated, which when transcribed, produce antisense RNA that is complementary to all or part(s) of a targeted messenger RNA(s). The antisense RNA reduces production of the polypeptide product of the messenger RNA. The polypeptide product may be any protein encoded by the plant genome. The aforementioned genes will be referred to as antisense genes. An antisense gene may thus be introduced into a plant by transformation methods to produce a novel transgenic plant with reduced expression of a selected protein of interest. For example, the protein may be an enzyme that catalyzes a reaction in the plant. Reduction of the enzyme activity may reduce or eliminate products of the reaction which include any enzymatically synthesized compound in the plant such as fatty acids, amino acids, carbohydrates, nucleic acids and the like. Alternatively, the protein may be a storage protein, such as a zein, or a structural protein, the decreased expression of which may lead to changes in seed amino acid composition or plant morphological changes respectively. The possibilities cited above are provided only by way of example and do not represent the full range of applications.

Genes may also be constructed or isolated, which when transcribed produce RNA enzymes, or ribozymes, which can act as endoribonucleases and catalyze the cleavage of RNA molecules with selected sequences. The cleavage of selected messenger RNA's can result in the reduced production of their encoded polypeptide products. These genes may be used to prepare novel transgenic plants which possess them. The transgenic plants may possess reduced levels of polypeptides including but not limited to the polypeptides cited above that may be affected by antisense RNA.

It is also possible that genes may be introduced to produce novel transgenic plants which have reduced expression of a native gene product by a mechanism of cosuppression. It has been demonstrated in tobacco, tomato, and petunia (Goring et al, 1991; Smith et al., 1990; Napoli et al., 1990; van der Krol et al., 1990) that expression of the sense transcript of a native gene will reduce or eliminate expression of the native gene in a manner similar to that observed for antisense genes. The introduced gene may encode all or part of the targeted native protein but its translation may not be required for reduction of levels of that native protein.

For example, DNA elements including those of transposable elements such as Ds, Ac, or Mu, may be inserted into a gene and cause mutations. These DNA elements may be inserted in order to inactivate, or preferably activate, a $DIS^R$ gene and thereby "tag" a particular trait or produce the disease resistance trait. In this instance the transposable element does not cause instability of the tagged mutation, because the utility of the element does not depend on its ability to move in the genome. Once a desired trait is tagged, the introduced DNA sequence may be used to clone the corresponding gene, e.g., using the introduced DNA sequence as a PCR primer together with PCR gene cloning techniques (Shapiro, 1983; Dellaporta et al., 1988). Once identified, the entire gene(s) for the particular trait, including control or regulatory regions where desired may be isolated, cloned and manipulated as desired. The utility of DNA elements introduced into an organism for purposed of gene tagging is independent of the DNA sequence and does not depend on any biological activity of the DNA sequence, i.e., transcription into RNA or translation into protein. The sole function of the DNA element is to disrupt the DNA sequence of a gene.

It is contemplated that unexpressed DNA sequences, including novel synthetic sequences could be introduced into cells as proprietary "labels" of those cells and plants and seeds thereof. It would not be necessary for a label DNA element to disrupt the function of a gene endogenous to the host organism, as the sole function of this DNA would be to identify the origin of the organism. For example, one could introduce a unique DNA sequence into a plant and this DNA element would identify all cells, plants, and progeny of these cells as having arisen from that labeled source. It is proposed that inclusion of label DNAs would enable one to distinguish proprietary germplasm or germplasm derived from such, from unlabelled germplasm.

Another possible element which may be introduced is a matrix attachment region element (MAR), such as the chicken lysozyme A element (Stief et al., 1989), which can be positioned around an expressible gene of interest to effect an increase in overall expression of the gene and diminish position dependant effects upon incorporation into the plant genome (Stief et al., 1989; Phi-Van et al., 1990).

Genes may be introduced into plants, particularly commercially important cereals such as maize, wheat or rice, to improve the grain for which the cereal is primarily grown. A wide range of novel transgenic plants produced in this manner may be envisioned depending on the particular end use of the grain.

For example, the largest use of maize grain is for feed or food. Introduction of genes that alter the composition of the grain may greatly enhance the feed or food value. The primary components of maize grain are starch, protein, and oil. Each of these primary components of maize grain may be improved by altering its level or composition. Several examples may be mentioned for illustrative purposes but in no way provide an exhaustive list of possibilities.

The protein of many cereal grains is suboptimal for feed and food purposes especially when fed to pigs, poultry, and humans. The protein is deficient in several amino acids that are essential in the diet of these species, requiring the addition of supplements to the grain. Limiting essential amino acids may include lysine, methionine, tryptophan, threonine, valine, arginine, and histidine. Some amino acids become limiting only after the grain is supplemented with other inputs for feed formulations. For example, when the grain is supplemented with soybean meal to meet lysine requirements, methionine becomes limiting. The levels of these essential amino acids in seeds and grain may be elevated by mechanisms which include, but are not limited to, the introduction of genes to increase the biosynthesis of the amino acids, decrease the degradation of the amino acids, increase the storage of the amino acids in proteins, or increase transport of the amino acids to the seeds or grain.

One mechanism for increasing the biosynthesis of the amino acids is to introduce genes that deregulate the amino acid biosynthetic pathways such that the plant can no longer adequately control the levels that are produced. This may be done by deregulating or bypassing steps in the amino acid biosynthetic pathway which are normally regulated by levels of the amino acid end product of the pathway. Examples include the introduction of genes that encode deregulated versions of the enzymes aspartokinase or dihydrodipicolinic acid (DHDP)-synthase for increasing lysine and threonine production, and anthranilate synthase for increasing tryptophan production. Reduction of the catabolism of the amino acids may be accomplished by introduction of DNA sequences that reduce or eliminate the expression of genes encoding enzymes that catalyse steps in the catabolic pathways such as the enzyme lysine-ketoglutarate reductase.

The protein composition of the grain may be altered to improve the balance of amino acids in a variety of ways including elevating expression of native proteins, decreasing expression of those with poor composition, changing the composition of native proteins, or introducing genes encoding entirely new proteins possessing superior composition. DNA may be introduced that decreases the expression of members of the zein family of storage proteins. This DNA may encode ribozymes or antisense sequences directed to impairing expression of zein proteins or expression of regulators of zein expression such as the opaque-2 gene product. The protein composition of the grain may be modified through the phenomenon of cosuppression, i.e., inhibition of expression of an endogenous gene through the expression of an identical structural gene or gene fragment introduced through transformation (Goring et al., 1991). Additionally, the introduced DNA may encode enzymes which degrade seines. The decreases in zein expression that are achieved may be accompanied by increases in proteins with more desirable amino acid composition or increases in other major seed constituents such as starch. Alternatively, a chimeric gene may be introduced that comprises a coding sequence for a native protein of adequate amino acid composition such as for one of the globulin proteins or 10 kD zein of maize and a promoter or other regulatory sequence designed to elevate expression of said protein. The coding sequence of said gene may include additional or replacement codons for essential amino acids. Further, a coding sequence obtained from another species, or, a partially or completely synthetic sequence encoding a completely unique peptide sequence designed to enhance the amino acid composition of the seed may be employed.

The introduction of genes that alter the oil content of the grain may be of value. Increases in oil content may result in increases in metabolizable energy content and density of the seeds for uses in feed and food. The introduced genes may encode enzymes that remove or reduce rate-limitations or regulated steps in fatty acid or lipid biosynthesis. Such genes may include, but are not limited to, those that encode acetyl-CoA carboxylase, ACP-acyltransferase, beta-ketoacyl-ACP synthase, plus other well known fatty acid biosynthetic activities. Other possibilities are genes that encode proteins that do not possess enzymatic activity such as acyl carrier protein. Additional examples include 2-acetyltransferase, oleosin pyruvate dehydrogenase complex, acetyl CoA synthetase, ATP citrate lyase, ADP-glucose pyrophosphorylase and genes of the camitine-CoA-acetyl-CoA shuttles. It is anticipated that expression of genes related to oil biosynthesis will be targeted to the plastid, using a plastid transit peptide sequence and preferably expressed in the seed embryo. Genes may be introduced that alter the balance of fatty acids present in the oil providing a more healthful or nutritive feedstuff. The introduced DNA may also encode sequences that block expression of enzymes involved in fatty acid biosynthesis, altering the proportions of fatty acids present in the grain such as described below.

Genes may be introduced that enhance the nutritive value of the starch component of the grain, for example by increasing the degree of branching, resulting in improved utilization of the starch in cows by delaying its metabolism.

Besides affecting the major constituents of the grain, genes may be introduced that affect a variety of other nutritive, processing, or other quality aspects of the grain as used for feed or food. For example, pigmentation of the grain may be increased or decreased. Enhancement and stability of yellow pigmentation is desirable in some animal feeds and may be achieved by introduction of genes that result in enhanced production of xanthophylls and carotenes by eliminating rate-limiting steps in their production. Such genes may encode altered forms of the enzymes phytoene synthase, phytoene desaturase, or lycopene synthase. Alternatively, unpigmented white corn is desirable for production of many food products and may be produced by the introduction of DNA which blocks or eliminates steps in pigment production pathways.

Feed or food comprising some cereal grains possesses insufficient quantities of vitamins and must be supplemented to provide adequate nutritive value. Introduction of genes that enhance vitamin biosynthesis in seeds may be envisioned including, for example, vitamins A, E, $B_{12}$, choline, and the like. For example, maize grain also does not possess sufficient mineral content for optimal nutritive value. Genes that affect the accumulation or availability of compounds containing phosphorus, sulfur, calcium, manganese, zinc, and iron among others would be valuable. An example may be the introduction of a gene that reduced phytic acid production or encoded the enzyme phytase which enhances phytic acid breakdown. These genes would increase levels of available phosphate in the diet, reducing the need for supplementation with mineral phosphate.

Numerous other examples of improvement of cereals for feed and food purposes might be described. The improvements may not even necessarily involve the grain, but may, for example, improve the value of the grain for silage. Introduction of DNA to accomplish this might include sequences that alter lignin production such as those that result in the "brown midrib" phenotype associated with superior feed value for cattle.

In addition to direct improvements in feed or food value, genes may also be introduced which improve the processing of grain and improve the value of the products resulting from the processing. The primary method of processing certain grains such as maize is via wetmilling. Maize may be improved though the expression of novel genes that increase the efficiency and reduce the cost of processing such as by decreasing steeping time.

Improving the value of wetmilling products may include altering the quantity or quality of starch, oil, corn gluten meal, or the components of corn gluten feed. Elevation of starch may be achieved through the identification and elimination of rate limiting steps in starch biosynthesis or by decreasing levels of the other components of the grain resulting in proportional increases in starch. An example of the former may be the introduction of genes encoding ADP-glucose pyrophosphorylase enzymes with altered regulatory activity or which are expressed at higher level. Examples of the latter may include selective inhibitors of, for example, protein or oil biosynthesis expressed during later stages of kernel development.

The properties of starch may be beneficially altered by changing the ratio of amylose to amylopectin, the size of the starch molecules, or their branching pattern. Through these changes a broad range of properties may be modified which include, but are not limited to, changes in gelatinization temperature, heat of gelatinization, clarity of films and pastes, Theological properties, and the like. To accomplish these changes in properties, genes that encode granule-bound or soluble starch synthase activity or branching enzyme activity may be introduced alone or combination. DNA such as antisense constructs may also be used to decrease levels of endogenous activity of these enzymes. The introduced genes or constructs may possess regulatory sequences that time their expression to specific intervals in starch biosynthesis and starch granule development. Furthermore, it may be advisable to introduce and express genes that result in the in vivo derivatization, or other modification, of the glucose moieties of the starch molecule. The covalent attachment of any molecule may be envisioned, limited only by the existence of enzymes that catalyze the derivatizations and the accessibility of appropriate substrates in the starch granule. Examples of important derivations may include the addition of functional groups such as amines, carboxyls, or phosphate groups which provide sites for subsequent in vitro derivatizations or affect starch properties through the introduction of ionic charges. Examples of other modifications may include direct changes of the glucose units such as loss of hydroxyl groups or their oxidation to aldehyde or carboxyl groups.

Oil is another product of wetmilling of corn and other grains, the value of which may be improved by introduction and expression of genes. The quantity of oil that can be extracted by wetmilling may be elevated by approaches as described for feed and food above. Oil properties may also be altered to improve its performance in the production and use of cooking oil, shortenings, lubricants or other oil-derived products or improvement of its health attributes when used in the food-related applications. Novel fatty acids may also be synthesized which upon extraction can serve as starting materials for chemical syntheses. The changes in oil properties may be achieved by altering the type, level, or lipid arrangement of the fatty acids present in the oil. This in turn may be accomplished by the addition of genes that encode enzymes that catalyze the synthesis of novel fatty acids and the lipids possessing them or by increasing levels of native fatty acids while possibly reducing levels of precursors. Alternatively DNA sequences may be introduced which slow or block steps in fatty acid biosynthesis resulting in the increase in precursor fatty acid intermediates. Genes that might be added include desaturases, epoxidases, hydratases, dehydratases, and other enzymes that catalyze reactions involving fatty acid intermediates. Representative examples of catalytic steps that might be blocked include the desaturations from stearic to oleic acid and oleic to linolenic acid resulting in the respective accumulations of stearic and oleic acids.

Improvements in the other major cereal wetmilling products, gluten meal and gluten feed, may also be achieved by the introduction of genes to obtain novel plants. Representative possibilities include but are not limited to those described above for improvement of food and feed value.

In addition it may further be considered that the plant be used for the production or manufacturing of useful biological compounds that are either not produced at all, or not produced at the same level, in the plant previously. The novel plants producing these compounds are made possible by the introduction and expression of genes by transformation methods. The possibilities include, but are not limited to, any biological compound which is presently produced by any organism such as proteins, nucleic acids, primary and intermediary metabolites, carbohydrate polymers, etc. The compounds may be produced by the plant, extracted upon harvest and/or processing, and used for any presently recognized useful purpose such as pharmaceuticals, fragrances, industrial enzymes to name a few.

Further possibilities to exemplify the range of grain traits or properties potentially encoded by introduced genes in transgenic plants include grain with less breakage susceptibility for export purposes or larger grit size when processed by dry milling through introduction of genes that enhance gamma-zein synthesis, popcorn with improved popping quality and expansion volume through genes that increase pericarp thickness, corn with whiter grain for food uses though introduction of genes that effectively block expression of enzymes involved in pigment production pathways, and improved quality of alcoholic beverages or sweet corn through introduction of genes which affect flavor such as the shrunken gene (encoding sucrose synthase) for sweet corn.

Two of the factors determining where plants can be grown are the average daily temperature during the growing season and the length of time between frosts. Within the areas where it is possible to grow a particular plant there are varying limitations on the maximal time it is allowed to grow to maturity and be harvested. The plant to be grown in a particular area is selected for its ability to mature and dry down to harvestable moisture content within the required period of time with maximum possible yield. Therefore, plant of varying maturities are developed for different growing locations. Apart from the need to dry down sufficiently to permit harvest is the desirability of having maximal drying take place in the field to minimize the amount of energy required for additional drying post-harvest. Also the more readily the grain can dry down, the more time there is available for growth and kernel fill. Genes that influence maturity and/or dry down can be identified and introduced into plant lines using transformation techniques to create new varieties adapted to different growing locations or the same growing location but having improved yield to moisture ratio at harvest. Expression of genes that are involved in regulation of plant development may be especially useful, e.g., the liguleless and rough sheath genes that have been identified in plants.

Genes may be introduced into plants that would improve standability and other plant growth characteristics. For example, expression of novel genes which confer stronger stalks, improved root systems, or prevent or reduce ear droppage would be of great value to the corn farmer. Introduction and expression of genes that increase the total amount of photoassimilate available by, for example, increasing light distribution and/or interception would be advantageous. In addition the expression of genes that increase the efficiency of photosynthesis and/or the leaf canopy would further increase gains in productivity. Such approaches would allow for increased plant populations in the field.

Delay of late season vegetative senescence would increase the flow of assimilate into the grain and thus increase yield. Overexpression of genes within plants that are associated with "stay green" or the expression of any gene that delays senescence would achieve be advantageous. For example, a non-yellowing mutant has been identified in Festuca pratensis (Davies et al., 1990). Expression of this gene as well as others may prevent premature breakdown of chlorophyll and thus maintain canopy function.

The ability to utilize available nutrients and minerals may be a limiting factor in growth of many plants. It is proposed that it would be possible to alter nutrient uptake, tolerate pH extremes, mobilization through the plant, storage pools, and availability for metabolic activities by the introduction of novel genes. These modifications would allow a plant to more efficiently utilize available nutrients. It is contemplated that an increase in the activity of, for example, an enzyme that is normally present in the plant and involved in nutrient utilization would increase the availability of a nutrient. An example of such an enzyme would be phytase. It is also contemplated that expression of a novel gene may make a nutrient source available that is previously not accessible, e.g., an enzyme that releases a component of nutrient value from a more complex molecule, perhaps a macromolecule.

Male sterility is useful in the production of hybrid seed. It is proposed that male sterility may be produced through expression of novel genes. For example, it has been shown that expression of genes that encode proteins that interfere with development of the male inflorescence and/or gametophyte result in male sterility. Chimeric ribonuclease genes that express in the anthers of transgenic tobacco and oilseed rape have been demonstrated to lead to male sterility (Mariani et al, 1990).

For example, a number of mutations are discovered in maize that confer cytoplasmic male sterility. One mutation in particular, referred to as T cytoplasm, also correlates with sensitivity to Southern corn leaf blight. A DNA sequence, designated TURF-13 (Levings, 1990), is identified that correlates with T cytoplasm. It would be possible through the introduction of TURF-13 via transformation to separate male sterility from disease sensitivity. As it is necessary to be able to restore male fertility for breeding purposes and for grain production, it is proposed that genes encoding restoration of male fertility may also be introduced.

Introduction of genes encoding traits that can be selected against may be useful for eliminating undesirable linked genes. When two or more genes are introduced together by cotransformation, the genes will be linked together on the host chromosome. For example, a gene encoding a Bt gene that confers insect resistance on the plant may be introduced into a plant together with a bar gene that is useful as a selectable marker and confers resistance to the herbicide Ignite® on the plant. However, it may not be desirable to have an insect resistant plant that is also resistant to the herbicide Ignite®. It is proposed that one could also introduce an antisense bar gene that is expressed in those tissues where one does not want expression of the bar gene, e.g., in whole plant parts. Hence, although the bar gene is expressed and is useful as a selectable marker, it is not useful to confer herbicide resistance on the whole plant. The bar antisense gene is a negative selectable marker.

Negative selection is necessary in order to screen a population of transformants for rare homologous recombinants generated through gene targeting. For example, a homologous recombinant may be identified through the inactivation of a gene that is previously expressed in that cell. The antisense gene to neomycin phosphotransferase II (nptII) has been investigated as a negative selectable marker in tobacco (*Nicotiana tabacum*) and *Arabidopsis thaliana* (Xiang and Guerra, 1993). In this example both sense and antisense nptII genes are introduced into a plant through transformation and the resultant plants are sensitive to the antibiotic kanamycin. An introduced gene that integrates into the host cell chromosome at the site of the antisense nptII gene, and inactivates the antisense gene, will make the plant resistant to kanamycin and other aminoglycoside antibiotics. Therefore, rare site specific recombinants may be identified by screening for antibiotic resistance. Similarly, any gene, native to the plant or introduced through transformation, that when inactivated confers resistance to a compound, may be useful as a negative selectable marker.

It is contemplated that negative selectable markers may also be useful in other ways. One application is to construct transgenic lines in which one could select for transposition to unlinked sites. In the process of tagging it is most common for the transposable element to move to a genetically linked site on the same chromosome. A selectable marker for recovery of rare plants in which transposition has occurred to an unlinked locus would be useful. For example, the enzyme cytosine deaminase may be useful for this purpose (Stouggard, 1993). In the presence of this enzyme the compound 5-fluorocytosine is converted to 5-fluoruracil which is toxic to plant and animal cells. If a transposable element is linked to the gene for the enzyme cytosine deaminase, one may select for transposition to unlinked sites by selecting for transposition events in which the resultant plant is now resistant to 5-fluorocytosine. The parental plants and plants containing transpositions to linked sites will remain sensitive to 5-fluorocytosine. Resistance to 5-fluorocytosine is due to loss of the cytosine deaminase gene through genetic segregation of the transposable element and the cytosine deaminase gene. Other genes that encode proteins that render the plant sensitive to a certain compound will also be useful in this context. For example, T-DNA gene 2 from *Agrobacterium tumefaciens* encodes a protein that catalyzes the conversion of alpha-naphthalene acetamide (NAM) to alpha-napthalene acetic acid (NAA) renders plant cells sensitive to high concentrations of NAM (Depicker et al., 1988).

It is also contemplated that negative selectable markers may be useful in the construction of transposon tagging lines. For example, by marking an autonomous transposable element such as Ac, Master Mu, or En/Spn with a negative selectable marker, one could select for transformants in which the autonomous element is not stably integrated into the genome. This would be desirable, for example, when transient expression of the autonomous element is desired to activate in trans the transposition of a defective transposable element, such as Ds, but stable integration of the autonomous element is not desired. The presence of the autonomous element may not be desired in order to stabilize the defective element, i.e., prevent it from further transposing. However, it is proposed that if stable integration of an autonomous transposable element is desired in a plant the presence of a negative selectable marker may make it possible to eliminate the autonomous element during the breeding process.

Plant species may be transformed with the DNA construct of the present invention by the DNA-mediated transformation of plant cell protoplasts and subsequent regeneration of the plant from the transformed protoplasts in accordance with procedures well known in the art.

Any plant tissue capable of subsequent clonal propagation, whether by organogenesis or embryogenesis, may be transformed with a vector of the present invention. The term "organogenesis," as used herein, means a process by which shoots and roots are developed sequentially from meristematic centers; the term "embryogenesis," as used herein, means a process by which shoots and roots develop together in a concerted fashion (not sequentially), whether from somatic cells or gametes. The particular tissue chosen will vary depending on the clonal propagation systems available for, and best suited to, the particular species being transformed. Exemplary tissue targets include leaf disks, pollen, embryos, cotyledons, hypocotyls, megagametophytes, callus tissue, existing meristematic tissue (e.g., apical meristems, axillary buds, and root meristems), and induced meristem tissue (e.g., cotyledon meristem and ultilane meristem).

Plants of the present invention may take a variety of forms. The plants may be chimeras of transformed cells and non-transformed cells; the plants may be clonal transformants (e.g., all cells transformed to contain the expression cassette); the plants may comprise grafts of transformed and untransformed tissues (e.g., a transformed root stock grafted to an untransformed scion in citrus species). The transformed plants may be propagated by a variety of means, such as by clonal propagation or classical breeding techniques. For example, first generation (or T1) transformed plants may be selfed to give homozygous second generation (or T2) transformed plants, and the T2 plants further propagated through classical breeding techniques. A dominant selectable marker (such as npt II) can be associated with the expression cassette to assist in breeding.

Thus, the present invention provides a transformed (transgenic) plant cell, in planta or ex planta, including a transformed plastid or other organelle, e.g., nucleus, mitochondria or chloroplast. The present invention may be used for transformation of any plant species, including, but not limited to, cells from corn (*Zea mays*), *Brassica* sp. (e.g., *B. napus, B. rapa, B. juncea*), particularly those *Brassica* species useful as sources of seed oil, alfalfa (*Medicago sativa*), rice (*Oryza sativa*), rye (*Secale cereale*), sorghum (*Sorghum bicolor, Sorghum vulgare*), millet (e.g., pearl millet (*Pennisetum glaucum*), proso millet (*Panicum miliaceum*), foxtail millet (*Setaria italica*), finger millet (*Eleusine coracana*)), sunflower (*Helianthus annuus*), safflower (*Carthamus tinctorius*), wheat (*Triticum aestivum*), soybean (*Glycine max*), tobacco (*Nicotiana tabacum*), potato (*Solanum tuberosum*), peanuts (*Arachis hypogaea*), cotton (*Gossypium barbadense, Gossypium hirsutum*), sweet potato (*Ipomoea batatas*), cassava (*Manihot esculenta*), coffee (*Cofea* spp.), coconut (*Cocos nucifera*), pineapple (*Ananas comosus*), citrus trees (*Citrus* spp.), cocoa (*Theobroma cacao*), tea (*Camellia sinensis*), banana (*Musa* spp.), avocado (*Persea ultilane*), fig (*Ficus casica*), guava (*Psidium guajava*), mango (*Mangifera indica*), olive (*Olea europaea*), papaya (*Carica papaya*), cashew (*Anacardium occidentale*), macadamia (*Macadamia integrifolia*), almond (*Prunus amygdalus*), sugar beets (*Beta vulgaris*), sugarcane (*Saccharum* spp.), oats, duckweed (*Lemna*), barley, vegetables, ornamentals, and conifers.

Duckweed (*Lemna*, see WO 00/07210) includes members of the family Lemnaceae. There are known four genera and 34 species of duckweed as follows: genus *Lemna* (*L. aequinoctialis, L. disperma, L. ecuadoriensis, L. gibba, L. japonica, L. minor, L. miniscula, L. obscura, L. perpusilla, L. tenera, L. trisulca, L. turionifera, L. valdiviana*); genus *Spirodela* (*S. intermedia, S. polyrrhiza, S. punctata*); genus *Woffia* (*Wa. Angusta, Wa. Arrhiza, Wa. Australina, Wa. Borealis, Wa. Brasiliensis, Wa. Columbiana, Wa. Elongata, Wa. Globosa, Wa. Microscopica, Wa. Neglecta*) and genus *Wofiella* (*Wl. ultila, Wl. ultilanen, Wl. gladiata, Wl. ultila, Wl. lingulata, Wl. repunda, Wl. rotunda*, and *Wl. neotropica*). Any other genera or species of Lemnaceae, if they exist, are also aspects of the present invention. *Lemna gibba, Lemna minor*, and *Lemna miniscula* are preferred, with *Lemna minor* and *Lemna miniscula* being most preferred. *Lemna* species can be classified using the taxonomic scheme described by Landolt, Biosystematic Investigation on the Family of Duckweeds: The fly of Lemnaceae—A Monograph Study. Geobatanischen Institut ETH, Stiftung Rubel, Zurich (1986)).

Vegetables within the scope of the invention include tomatoes (*Lycopersicon esculentum*), lettuce (e.g., *Lactuca sativa*), green beans (*Phaseolus vulgaris*), lima beans (*Phaseolus limensis*), peas (*Lathyrus* spp.), and members of the genus *Cucumis* such as cucumber (*C. sativus*), cantaloupe (*C. cantalupensis*), and musk melon (*C. melo*). Ornamentals include azalea (*Rhododendron* spp.), hydrangea (*Macrophylla hydrangea*), hibiscus (*Hibiscus rosasanensis*), roses (*Rosa* spp.), tulips (*Tulipa* spp.), daffodils (*Narcissus* spp.), petunias (*Petunia hybrida*), carnation (*Dianthus caryophyllus*), poinsettia (*Euphorbia pulcherrima*), and chrysanthemum Conifers that may be employed in practicing the present invention include, for example, pines such as loblolly pine (*Pinus taeda*), slash pine (*Pinus elliotii*), ponderosa pine (*Pinus ponderosa*), lodgepole pine (*Pinus contorta*), and Monterey pine (*Pintis radiata*), Douglas-fir (*Pseudotsuga menziesii*); Western hemlock (*Tsuga ultilane*); Sitka spruce (*Picea glauca*); redwood (*Sequoia sempervirens*); true firs such as silver fir (*Abies amabilis*) and balsam fir (*Abies balsamea*); and cedars such as Western red cedar (*Thuja plicata*) and Alaska yellow-cedar (*Chamaecyparis nootkatensis*). Leguminous plants include beans and peas. Beans include guar, locust bean, fenugreek, soybean, garden beans, cowpea, mungbean, lima bean, fava bean, lentils, chickpea, etc. Legunes include, but are not limited to, *Arachis*, e.g., peanuts, *Vicia*, e.g., crown vetch, hairy vetch, adzuki bean, mung bean, and chickpea, *Lupinus*, e.g., lupine, trifolium, *Phaseolus*, e.g., common bean and lima bean, *Pisum*, e.g., field bean, *Melilotus*, e.g., clover, *Medicago*, e.g., alfalfa, Lotus, e.g., trefoil, lens, e.g., lentil, and false indigo. Preferred forage and turf grass for use in the methods of the invention include alfalfa, orchard grass, tall fescue, perennial ryegrass, creeping bent grass, and redtop.

Papaya, garlic, pea, peach, pepper, petunia, strawberry, sorghum, sweet potato, turnip, safflower, corn, pea, endive, gourd, grape, snap bean, chicory, cotton, tobacco, aubergine, beet, buckwheat, broad bean, nectarine, avocado, mango, banana, groundnut, potato, peanut, lettuce, pineapple, spinach, squash, sugarbeet, sugarcane, sweet corn, chrysanthemum.

Other plants within the scope of the invention include *Acacia*, aneth, artichoke, arugula, blackberry, canola, cilantro, clementines, escarole, eucalyptus, fennel, grapefruit, honey dew, jicama, kiwifruit lemon, lime, mushroom, nut, okra, orange, parsley, persimmon, plantain, pomegranate, poplar, radiata pine, radicchio, Southern pine, sweetgum, tangerine, triticale, vine, yams, apple, pear, quince, cherry, apricot, melon, hemp, buckwheat, grape, raspberry, chenopodium, blueberry, nectarine, peach, plum, strawberry, watermelon, eggplant, pepper, cauliflower, Brassica, e.g., broccoli, cabbage, ultilan sprouts, onion, carrot, leek, beet, broad bean, celery, radish, pumpkin, endive, gourd, garlic, snapbean, spinach, squash, turnip, ultilane, and zucchini.

Ornamental plants within the scope of the invention include impatiens, Begonia, Pelargonium, Viola, Cyclamen, Verbena, Vinca, Tagetes, Primula, Saint Paulia, Agerdum, Amaranthus, Antihirrhinum, Aquilegia, Cineraria, Clover, Cosmo, Cowpea, Dahlia, Datura, Delphinium, Gerbera, Gladiolus, Gloxinia, Hippeastran, Mesembryanthemum, Salpiglossos, and Zinnia.

Other vegetable sources to be transformed include Cucurbitaceae, e.g., *Cucumis sativus, Cucuinis melo, Citrullus lanatus, Cucurbita pepo, Cucurbita maxima*, and *Cucurbita moschata*; Solanaceae, e.g., *Lycopersicon esculentum, Capsicum annuum, Capsicum frutescens, Solanum melongena, Nicotiana tabacum, Solanum tuberosum*, Petunia×hybrida hort. ex E. Vilm.; Brassicaceae, e.g., *Brassica oleracea* L. var. italica, *Brassica oleracea* L. var. capitata, *Brassica rapa, Brassica oleracea* L. var. botrytis, *Raphanus sativus* var.

niger*, and *Brassica napus*; Umbelliferae, e.g., *Daucus carota*, Compositae, e.g., *Lactuca sativa*, and *Helianthus annuus*; Chenopodiaceae, e.g., *Spinacia oleracea* and *Beta vulgaris*; Leguminosae, e.g., *Phaseolus vulgaris, Pisum sativum*, and *Glycine max*; Gramineae, e.g., *Zea mays*; or Liliaceae, e.g., *Allium cepa.*

Preferably, transgenic plants of the present invention are crop plants and in particular cereals (for example, corn, alfalfa, sunflower, rice, *Brassica*, canola, soybean, barley, soybean, sugarbeet, cotton, safflower, peanut, sorghum, wheat, millet, tobacco, etc.), and even more preferably corn, rice and soybean.

Transformation of plants can be undertaken with a single DNA molecule or multiple DNA molecules (i.e., co-transformation), and both these techniques are suitable for use with the expression cassettes of the present invention. Numerous transformation vectors are available for plant transformation, and the expression cassettes of this invention can be used in conjunction with any such vectors. The selection of vector will depend upon the preferred transformation technique and the target species for transformation.

A variety of techniques are available and known to those skilled in the art for introduction of constructs into a plant cell host. These techniques generally include transformation with DNA employing *A. tumefaciens* or *A. rhizogenes* as the transforming agent, liposomes, PEG precipitation, electroporation, DNA injection, direct DNA uptake, microprojectile bombardment, particle acceleration, and the like (See, for example, EP 295959 and EP 138341) (see below). However, cells other than plant cells may be transformed with the expression cassettes of the invention. The general descriptions of plant expression vectors and reporter genes, and *Agrobacterium* and *Agrobacterium*-mediated gene transfer, can be found in Gruber et al. (1993).

Expression vectors containing genomic or synthetic fragments can be introduced into protoplasts or into intact tissues or isolated cells. Preferably expression vectors are introduced into intact tissue. General methods of culturing plant tissues are provided for example by Maki et al., (1993); and by Phillips et al. (1988). Preferably, expression vectors are introduced into maize or other plant tissues using a direct gene transfer method such as microprojectile-mediated delivery, DNA injection, electroporation and the like. More preferably expression vectors are introduced into plant tissues using the microprojectile media delivery with the biolistic device. See, for example, Tomes et al. (1995). The vectors of the invention can not only be used for expression of structural genes but may also be used in exon-trap cloning, or promoter trap procedures to detect differential gene expression in varieties of tissues, (Lindsey et al., 1993; Auch & Reth et al.).

It is particularly preferred to use the binary type vectors of Ti and Ri plasmids of *Agrobacterium* spp. Ti-derived vectors transform a wide variety of higher plants, including monocotyledonous and dicotyledonous plants, such as soybean, cotton, rape, tobacco, and rice (Pacciotti et al., 1985: Byrne et al., 1987; Sukhapinda et al., 1987; Park et al., 1985: Hiei et al., 1994). The use of T-DNA to transform plant cells has received extensive study and is amply described (EP 120516; Hoekema, 1985; Knauf, et al., 1983; and An et al., 1985). For introduction into plants, the chimeric genes of the invention can be inserted into binary vectors as described in the examples.

Other transformation methods are available to those skilled in the art, such as direct uptake of foreign DNA constructs (see EP 295959), techniques of electroporation (Fromm et al., 1986) or high velocity ballistic bombardment with metal particles coated with the nucleic acid constructs (Kline et al., 1987, and U.S. Pat. No. 4,945,050). Once transformed, the cells can be regenerated by those skilled in the art. Of particular relevance are the recently described methods to transform foreign genes into commercially important crops, such as rapeseed (De Block et al., 1989), sunflower (Everett et al., 1987), soybean (McCabe et al., 1988; Hinchee et al., 1988; Chee et al., 1989; Christou et al., 1989; EP 301749), rice (Hiei et al., 1994), and corn (Gordon Kamm et al., 1990; Fromm et al., 1990).

Those skilled in the art will appreciate that the choice of method might depend on the type of plant, i.e., monocotyledonous or dicotyledonous, targeted for transformation. Suitable methods of transforming plant cells include, but are not limited to, microinjection (Crossway et al., 1986), electroporation (Riggs et al., 1986), *Agrobacterium*-mediated transformation (Hinchee et al., 1988), direct gene transfer (Paszkowski et al., 1984), and ballistic particle acceleration using devices available from Agracetus, Inc., Madison, Wis. And BioRad, Hercules, Calif. (see, for example, Sanford et al., U.S. Pat. No. 4,945,050; and McCabe et al., 1988). Also see, Weissinger et al., 1988; Sanford et al., 1987 (onion); Christou et al., 1988 (soybean); McCabe et al., 1988 (soybean); Datta et al., 1990 (rice); Klein et al., 1988 (maize); Klein et al., 1988 (maize); Klein et al., 1988 (maize); Fromm et al., 1990 (maize); and Gordon-Kamm et al., 1990 (maize); Svab et al., 1990 (tobacco chloroplast); Koziel et al., 1993 (maize); Shimamoto et al., 1989 (rice); Christou et al., 1991 (rice); European Patent Application EP 0 332 581 (orchardgrass and other Pooideae); Vasil et al., 1993 (wheat); Weeks et al., 1993 (wheat). In one embodiment, the protoplast transformation method for maize is employed (European Patent Application EP 0 292 435, U.S. Pat. No. 5,350,689).

In another embodiment, a nucleotide sequence of the present invention is directly transformed into the plastid genome. Plastid transformation technology is extensively described in U.S. Pat. Nos. 5,451,513, 5,545,817, and 5,545,818, in PCT application no. WO 95/16783, and in McBride et al., 1994. The basic technique for chloroplast transformation involves introducing regions of cloned plastid DNA flanking a selectable marker together with the gene of interest into a suitable target tissue, e.g., using biolistics or protoplast transformation (e.g., calcium chloride or PEG mediated transformation). The 1 to 1.5 kb flanking regions, termed targeting sequences, facilitate orthologous recombination with the plastid genome and thus allow the replacement or modification of specific regions of the plastome. Initially, point mutations in the chloroplast 16S rRNA and rps12 genes conferring resistance to spectinomycin and/or streptomycin are utilized as selectable markers for transformation (Svab et al., 1990; Staub et al., 1992). This resulted in stable homoplasmic transformants at a frequency of approximately one per 100 bombardments of target leaves. The presence of cloning sites between these markers allowed creation of a plastid targeting vector for introduction of foreign genes (Staub et al., 1993). Substantial increases in transformation frequency are obtained by replacement of the recessive rRNA or r-protein antibiotic resistance genes with a dominant selectable marker, the bacterial aadA gene encoding the spectinomycin-detoxifying enzyme aminoglycoside-3N-adenyltransferase (Svab et al., 1993). Other selectable markers useful for plastid transformation are known in the art and encompassed within the scope of the invention. Typically, approximately 15-20 cell division cycles following transformation are required to reach a homoplastidic state. Plastid expression, in which genes are inserted by orthologous recombination into all of the several thousand copies of the circular plastid genome present in each plant cell, takes advantage of the enormous copy number advantage over nuclear-expressed genes to permit expression levels that can readily exceed 10% of the total soluble plant protein. In a preferred embodiment, a nucleotide sequence of the present invention is inserted into a plastid targeting vector and transformed into the plastid genome of a desired plant host. Plants homoplastic for plastid genomes containing a nucleotide sequence of the present invention are obtained, and are preferentially capable of high expression of the nucleotide sequence.

Agrobacterium tumefaciens cells containing a vector comprising an expression cassette of the present invention, wherein the vector comprises a Ti plasmid, are useful in methods of making transformed plants. Plant cells are infected with an Agrobacterium tumefaciens as described above to produce a transformed plant cell, and then a plant is regenerated from the transformed plant cell. Numerous Agrobacterium vector systems useful in carrying out the present invention are known.

For example, vectors are available for transformation using Agrobacterium tumefaciens. These typically carry at least one T-DNA border sequence and include vectors such as pBIN19 (Bevan, 1984). In one preferred embodiment, the expression cassettes of the present invention may be inserted into either of the binary vectors pCIB200 and pCIB2001 for use with Agrobacterium. These vector cassettes for Agrobacterium-mediated transformation wear constructed in the following manner. PTJS75kan is created by NarI digestion of pTJS75 (Schmidhauser & Helinski, 1985) allowing excision of the tetracycline-resistance gene, followed by insertion of an AccI fragment from pUC4K carrying an NPTII (Messing & Vierra, 1982; Bevan et al., 1983; McBride et al., 1990). XhoI linkers are ligated to the EcoRV fragment of pCIB7 which contains the left and right T-DNA borders, a plant selectable nos/nptII chimeric gene and the pUC polylinker (Rothstein et al., 1987), and the XhoI-digested fragment is cloned into SalI-digested pTJS75kan to create pCIB200 (see also EP 0 332 104, example 19). PCIB200 contains the following unique polylinker restriction sites: EcoRI, SstI, KpnI, BglII, XbaI, and SalI. The plasmid pCIB2001 is a derivative of pCIB200 which is created by the insertion into the polylinker of additional restriction sites. Unique restriction sites in the polylinker of pCIB2001 are EcoRI, SstI, KpnI, BglII, XbaI, SalI, MluI, BclI, AvrII, ApaI, HpaI, and StuI. PCIB2001, in addition to containing these unique restriction sites also has plant and bacterial kanamycin selection, left and right T-DNA borders for Agrobacterium-mediated transformation, the RK2-derived trfA function for mobilization between E. coli and other hosts, and the OriT and OriV functions also from RK2. The pCIB2001 polylinker is suitable for the cloning of plant expression cassettes containing their own regulatory signals.

An additional vector useful for Agrobacterium-mediated transformation is the binary vector pCIB 10, which contains a gene encoding kanamycin resistance for selection in plants, T-DNA right and left border sequences and incorporates sequences from the wide host-range plasmid pRK252 allowing it to replicate in both E. coli and Agrobacterium. Its construction is described by Rothstein et al., 1987. Various derivatives of pCIB10 have been constructed which incorporate the gene for hygromycin B phosphotransferase described by Gritz et al., 1983. These derivatives enable selection of transgenic plant cells on hygromycin only (pCIB743), or hygromycin and kanamycin (pCIB715, pCIB717).

Methods using either a form of direct gene transfer or Agrobacterium-mediated transfer usually, but not necessarily, are undertaken with a selectable marker which may provide resistance to an antibiotic (e.g., kanamycin, hygromycin or methotrexate) or a herbicide (e.g., phosphinothricin). The choice of selectable marker for plant transformation is not, however, critical to the invention.

For certain plant species, different antibiotic or herbicide selection markers may be preferred. Selection markers used routinely in transformation include the nptII gene which confers resistance to kanamycin and related antibiotics (Messing & Vierra, 1982; Bevan et al., 1983), the bar gene which confers resistance to the herbicide phosphinothricin (White et al., 1990, Spencer et al., 1990), the hph gene which confers resistance to the antibiotic hygromycin (Blochinger & Diggelmann), and the dhfr gene, which confers resistance to methotrexate (Bourouis et al., 1983).

One such vector useful for direct gene transfer techniques in combination with selection by the herbicide Basta (or phosphinothricin) is pCIB3064. This vector is based on the plasmid pCIB246, which comprises the CaMV 35S promoter in operational fusion to the E. coli GUS gene and the CaMV 35S transcriptional terminator and is described in the PCT published application WO 93/07278, herein incorporated by reference. One gene useful for conferring resistance to phosphinothricin is the bar gene from Streptomyces viridochromogenes (Thompson et al., 1987). This vector is suitable for the cloning of plant expression cassettes containing their own regulatory signals.

An additional transformation vector is pSOG35 which utilizes the E. coli gene dihydrofolate reductase (DHFR) as a selectable marker conferring resistance to methotrexate. PCR is used to amplify the 35S promoter (about 800 bp), intron 6 from the maize Adh1 gene (about 550 bp) and 18 bp of the GUS untranslated leader sequence from pSOG10. A 250 bp fragment encoding the E. coli dihydrofolate reductase type II gene is also amplified by PCR and these two PCR fragments are assembled with a SacI-PstI fragment from pBI221 (Clontech) which comprised the pUC19 vector backbone and the nopaline synthase terminator. Assembly of these fragments generated pSOG19 which contains the 35S promoter in fusion with the intron 6 sequence, the GUS leader, the DHFR gene and the nopaline synthase terminator. Replacement of the GUS leader in pSOG19 with the leader sequence from Maize Chlorotic Mottle Virus check (MCMV) generated the vector pSOG35. pSOG19 and pSOG35 carry the pUC-derived gene for ampicillin resistance and have HindIII, SphI, PstI and EcoRI sites available for the cloning of foreign sequences.

Transgenic plant cells are then placed in an appropriate selective medium for selection of transgenic cells which are then grown to callus. Shoots are grown from callus and plantlets generated from the shoot by growing in rooting medium. The various constructs normally will be joined to a marker for selection in plant cells. Conveniently, the marker may be resistance to a biocide (particularly an antibiotic, such as kanamycin, G418, bleomycin, hygromycin, chloramphenicol, herbicide, or the like). The particular marker used will allow for selection of transformed cells as compared to cells lacking the DNA which has been introduced. Components of DNA constructs including transcription cassettes of this invention may be prepared from sequences which are native (endogenous) or foreign (exogenous) to the host. By "foreign" it is meant that the sequence is not found in the wild-type host into which the construct is introduced. Heterologous constructs will contain at least one region which is not native to the gene from which the transcription-initiation-region is derived.

To confirm the presence of the transgenes in transgenic cells and plants, a variety of assays may be performed. Such assays include, for example, "molecular biological" assays well known to those of skill in the art, such as Southern and Northern blotting, in situ hybridization and nucleic acid-based amplification methods such as PCR or RT-PCR; "biochemical" assays, such as detecting the presence of a protein product, e.g., by immunological means (ELISAs and Western blots) or by enzymatic function; plant part assays, such as leaf or root assays; and also, by analyzing the phenotype of the whole regenerated plant, e.g., for disease or pest resistance.

DNA may be isolated from cell lines or any plant parts to determine the presence of the preselected nucleic acid segment through the use of techniques well known to those skilled in the art. Note that intact sequences will not always be present, presumably due to rearrangement or deletion of sequences in the cell.

The presence of nucleic acid elements introduced through the methods of this invention may be determined by polymerase chain reaction (PCR). Using this technique discreet fragments of nucleic acid are amplified and detected by gel electrophoresis. This type of analysis permits one to determine whether a preselected nucleic acid segment is present in a stable transformant, but does not prove integration of the introduced preselected nucleic acid segment into the host cell genome. In addition, it is not possible using PCR techniques to determine whether transformants have exogenous genes introduced into different sites in the genome, i.e., whether transformants are of independent origin. It is contemplated that using PCR techniques it would be possible to clone fragments of the host genomic DNA adjacent to an introduced preselected DNA segment.

Positive proof of DNA integration into the host genome and the independent identities of transformants may be determined using the technique of Southern hybridization. Using this technique specific DNA sequences that are introduced into the host genome and flanking host DNA sequences can be identified. Hence the Southern hybridization pattern of a given transformant serves as an identifying characteristic of that transformant. In addition it is possible through Southern hybridization to demonstrate the presence of introduced preselected DNA segments in high molecular weight DNA, i.e., confirm that the introduced preselected DNA segment has been integrated into the host cell genome. The technique of Southern hybridization provides information that is obtained using PCR, e.g., the presence of a preselected DNA segment, but also demonstrates integration into the genome and characterizes each individual transformant.

It is contemplated that using the techniques of dot or slot blot hybridization which are modifications of Southern hybridization techniques one could obtain the same information that is derived from PCR, e.g., the presence of a preselected DNA segment.

Both PCR and Southern hybridization techniques can be used to demonstrate transmission of a preselected DNA segment to progeny. In most instances the characteristic Southern hybridization pattern for a given transformant will segregate in progeny as one or more Mendelian genes (Spencer et al., 1992); Laursen et al., 1994) indicating stable inheritance of the gene. The nonchimeric nature of the callus and the parental transformants ($R_0$) is suggested by germline transmission and the identical Southern blot hybridization patterns and intensities of the transforming DNA in callus, $R_0$ plants and $R_1$ progeny that segregated for the transformed gene.

Whereas DNA analysis techniques may be conducted using DNA isolated from any part of a plant, RNA may only be expressed in particular cells or tissue types and hence it will be necessary to prepare RNA for analysis from these tissues. PCR techniques may also be used for detection and quantitation of RNA produced from introduced preselected DNA segments. In this application of PCR it is first necessary to reverse transcribe RNA into DNA, using enzymes such as reverse transcriptase, and then through the use of conventional PCR techniques amplify the DNA. In most instances PCR techniques, while useful, will not demonstrate integrity of the RNA product. Further information about the nature of the RNA product may be obtained by Northern blotting. This technique will demonstrate the presence of an RNA species and give information about the integrity of that RNA. The presence or absence of an RNA species can also be determined using dot or slot blot Northern hybridizations. These techniques are modifications of Northern blotting and will only demonstrate the presence or absence of an RNA species.

While Southern blotting and PCR may be used to detect the preselected DNA segment in question, they do not provide information as to whether the preselected DNA segment is being expressed. Expression may be evaluated by specifically identifying the protein products of the introduced preselected DNA segments or evaluating the phenotypic changes brought about by their expression.

Assays for the production and identification of specific proteins may make use of physical-chemical, structural, functional, or other properties of the proteins. Unique physical-chemical or structural properties allow the proteins to be separated and identified by electrophoretic procedures, such as native or denaturing gel electrophoresis or isoelectric focusing, or by chromatographic techniques such as ion exchange or gel exclusion chromatography. The unique structures of individual proteins offer opportunities for use of specific antibodies to detect their presence in formats such as an ELISA assay. Combinations of approaches may be employed with even greater specificity such as Western blotting in which antibodies are used to locate individual gene products that have been separated by electrophoretic techniques. Additional techniques may be employed to absolutely confirm the identity of the product of interest such as evaluation by amino acid sequencing following purification. Although these are among the most commonly employed, other procedures may be additionally used.

Assay procedures may also be used to identify the expression of proteins by their functionality, especially the ability of enzymes to catalyze specific chemical reactions involving specific substrates and products. These reactions may be followed by providing and quantifying the loss of substrates or the generation of products of the reactions by physical or chemical procedures. Examples are as varied as the enzyme to be analyzed.

Very frequently the expression of a gene product is determined by evaluating the phenotypic results of its expression. These assays also may take many forms including but not limited to analyzing changes in the chemical composition, morphology, or physiological properties of the plant. Morphological changes may include greater stature or thicker stalks. Most often changes in response of plants or plant parts to imposed treatments are evaluated under carefully controlled conditions termed bioassays.

Once an expression cassette of the invention has been transformed into a particular plant species, it may be propagated in that species or moved into other varieties of the same species, particularly including commercial varieties, using traditional breeding techniques. Particularly preferred plants of the invention include the agronomically important crops listed above. The genetic properties engineered into the transgenic seeds and plants described above are passed on by sexual reproduction and can thus be maintained and propagated in progeny plants. The present invention also relates to a transgenic plant cell, tissue, organ, seed or plant part obtained from the transgenic plant. Also included within the invention are transgenic descendants of the plant as well as transgenic plant cells, tissues, organs, seeds and plant parts obtained from the descendants.

Preferably, the expression cassette in the transgenic plant is sexually transmitted. In one preferred embodiment, the coding sequence is sexually transmitted through a complete normal sexual cycle of the R0 plant to the R1 generation. Additionally preferred, the expression cassette is expressed in the cells, tissues, seeds or plant of a transgenic plant in an amount that is different than the amount in the cells, tissues, seeds or plant of a plant which only differs in that the expression cassette is absent.

The transgenic plants produced herein are thus expected to be useful for a variety of commercial and research purposes. Transgenic plants can be created for use in traditional agriculture to possess the disease resistance traits beneficial to the grower or beneficial to the consumer of the grain harvested from the plant (e.g., reduced mycotoxin). In such uses, the plants are generally grown for the use of their grain in human or animal foods. Additionally, the use of root-specific promoters in transgenic plants can provide beneficial benefit by expressing a transgene of the invention in parts of the plant that are assaulted by a pathogen but not consumed by animals and humans. However, other parts of the plants, including stalks, husks, vegetative parts, and the like, may also have utility, including use as part of animal silage or for ornamental purposes. Transgenic plants may also find use in the commercial manufacture of proteins or other molecules, where the molecule of interest is extracted or purified from plant parts, seeds, and the like. Cells or tissue from the plants may also be cultured, grown in vitro, or fermented to manufacture such molecules. Enhancing disease resistance provides the benefit of increased quality control and consistency in crop yield and quality batch to batch.

The transgenic plants may also be used in commercial breeding programs, or may be crossed or bred to plants of related crop species. Improvements encoded by the expression cassette may be transferred, e.g., from maize cells to cells of other species, e.g., by protoplast fusion.

The transgenic plants may have many uses in research or breeding, including creation of new mutant plants through insertional mutagenesis, in order to identify beneficial mutants that might later be created by traditional mutation and selection. An example would be the introduction of a recombinant DNA sequence encoding a transposable element that may be used for generating genetic variation. The methods of the invention may also be used to create plants having unique "signature sequences" or other marker sequences which can be used to identify proprietary lines or varieties.

Thus, the transgenic plants and seeds according to the invention can be used in plant breeding which aims at the development of plants with improved properties conferred by the expression cassette, such as tolerance of disease. The various breeding steps are characterized by well-defined human intervention such as selecting the lines to be crossed, directing pollination of the parental lines, or selecting appropriate descendant plants. Depending on the desired properties different breeding measures are taken. The relevant techniques are well known in the art and include but are not limited to hybridization, inbreeding, backcross breeding, ultilane breeding, variety blend, interspecific hybridization, aneuploid techniques, etc. Hybridization techniques also include the sterilization of plants to yield male or female sterile plants by mechanical, chemical or biochemical means. Cross pollination of a male sterile plant with pollen of a different line assures that the genome of the male sterile but female fertile plant will uniformly obtain properties of both parental lines. Thus, the transgenic seeds and plants according to the invention can be used for the breeding of improved plant lines which for example increase the effectiveness of conventional methods such as herbicide or pesticide treatment or allow to dispense with said methods due to their modified genetic properties. Alternatively new crops with improved stress tolerance can be obtained which, due to their optimized genetic "equipment", yield harvested product of better quality than products which are not able to tolerate comparable adverse developmental conditions.

Polynucleotides derived from nucleotide sequences of the present invention having any of the nucleotide sequences provided in the Sequence Listing are useful to detect the presence in a test sample of at least one copy of a nucleotide sequence containing the same or substantially the same sequence, or a fragment, complement, or variant thereof. The sequence of the probes and/or primers of the instant invention need not be identical to those provided in the Sequence Listing or the complements thereof. Some variation in probe or primer sequence and/or length can allow additional family members to be detected, as well as orthologous genes and more taxonomically distant related sequences. Similarly probes and/or primers of the invention can include additional nucleotides that serve as a label for detecting duplexes, for isolation of duplexed polynucleotides, or for cloning purposes.

Preferred probes and primers of the invention include isolated, purified, or recombinant polynucleotides containing a contiguous span of between at least 12 to at least 1000 nucleotides of any nucleotide sequence which is substantially similar, and preferably has at least between 70% and 99% sequence identity to any one of *SEQ ID NOs provided in the Sequence Listing, or the complements thereof, with each individual number of nucleotides within this range also being part of the invention. Preferred are isolated, purified, or recombinant polynucleotides containing a contiguous span of at least 12, 15, 18, 20, 25, 30, 35, 40, 50, 60, 70, 80, 90, 100, 150, 200, 300, 400, 500, 750, or 1000 nucleotides of any nucleotide sequence which is substantially similar, and preferably has at least between 70% and 99% sequence identity to any one of *SEQ ID NOs provided in the Sequence Listing, or the complements thereof. The appropriate length for primers and probes will vary depending on the application. For use as PCR primers, probes are 12-40 nucleotides, preferably 18-30 nucleotides long. For use in mapping, probes are 50 to 500 nucleotides, preferably 100-250 nucleotides long. For use in Southern hybridizations, probes as long as several kilobases can be used. The appropriate length for primers and probes under a particular set of assay conditions may be empirically determined by one of skill in the art.

The primers and probes can be prepared by any suitable method, including, for example, cloning and restriction of appropriate sequences and direct chemical synthesis by a method such as the phosphodiester method of Narang et al. (*Meth Enzymol* 68: 90 (1979)), the diethylphosphoramidite method, the triester method of Matteucci et al. (*J Am Chem Soc* 103: 3185 (1981)), or according to Urdea et al. (*Proc Natl Acad* 80: 7461 (1981)), the solid support method described in EP 0 707 592, or using commercially available automated oligonucleotide synthesizers.

Detection probes are generally nucleotide sequences or uncharged nucleotide analogs such as, for example peptide nucleotides which are disclosed in International Patent Application WO 92/20702, morpholino analogs which are described in U.S. Pat. Nos. 5,185,444, 5,034,506 and 5,142,047. The probe may have to be rendered "non-extendable"

such that additional dNTPs cannot be added to the probe. Analogs are usually non-extendable, and nucleotide probes can be rendered non-extendable by modifying the 3' end of the probe such that the hydroxyl group is no longer capable of participating in elongation. For example, the 3' end of the probe can be functionalized with the capture or detection label to thereby consume or otherwise block the hydroxyl group. Alternatively, the 3' hydroxyl group simply can be cleaved, replaced or modified so as to render the probe non-extendable.

Any of the polynucleotides of the present invention can be labeled, if desired, by incorporating a label detectable by spectroscopic, photochemical, biochemical, immunochemical, or chemical means. For example, useful labels include radioactive substances ($^{32}P$, $^{35}S$, $^{3}H$, $^{125}I$), fluorescent dyes (5-bromodesoxyuridine, fluorescein, acetylaminofluorene, digoxigenin) or biotin. Preferably, polynucleotides are labeled at their 3' and 5' ends. Examples of non-radioactive labeling of nucleotide fragments are described in the French patent No. FR-7810975 and by Urdea et al. (*Nuc Acids Res* 16:4937 (1988)). In addition, the probes according to the present invention may have structural characteristics such that they allow the signal amplification, such structural characteristics being, for example, branched DNA probes as described in EP 0 225 807.

A label can also be used to capture the primer so as to facilitate the immobilization of either the primer or a primer extension product, such as amplified DNA, on a solid support. A capture label is attached to the primers or probes and can be a specific binding member that forms a binding pair with the solid's phase reagent's specific binding member, for example biotin and streptavidin. Therefore depending upon the type of label carried by a polynucleotide or a probe, it may be employed to capture or to detect the target DNA. Further, it will be understood that the polynucleotides, primers or probes provided herein, may, themselves, serve as the capture label. For example, in the case where a solid phase reagent's binding member is a nucleotide sequence, it may be selected such that it binds a complementary portion of a primer or probe to thereby immobilize the primer or probe to the solid phase. In cases where a polynucleotide probe itself serves as the binding member, those skilled in the art will recognize that the probe will contain a sequence or "tail" that is not complementary to the target. In the case where a polynucleotide primer itself serves as the capture label, at least a portion of the primer will be free to hybridize with a nucleotide on a solid phase. DNA labeling techniques are well known in the art.

Any of the polynucleotides, primers and probes of the present invention can be conveniently immobilized on a solid support. Solid supports are known to those skilled in the art and include the walls of wells of a reaction tray, test tubes, polystyrene beads, magnetic beads, nitrocellulose strips, membranes, microparticles such as latex particles, sheep (or other animal) red blood cells, duracytes and others. The solid support is not critical and can be selected by one skilled in the art. Thus, latex particles, microparticles, magnetic or non-magnetic beads, membranes, plastic tubes, walls of microtiter wells, glass or silicon chips, sheep (or other suitable animal's) red blood cells and duracytes are all suitable examples. Suitable methods for immobilizing nucleotides on solid phases include ionic, hydrophobic, covalent interactions and the like. A solid support, as used herein, refers to any material that is insoluble, or can be made insoluble by a subsequent reaction. The solid support can be chosen for its intrinsic ability to attract and immobilize the capture reagent. Alternatively, the solid phase can retain an additional receptor that has the ability to attract and immobilize the capture reagent. The additional receptor can include a charged substance that is oppositely charged with respect to the capture reagent itself or to a charged substance conjugated to the capture reagent. As yet another alternative, the receptor molecule can be any specific binding member which is immobilized upon (attached to) the solid support and which has the ability to immobilize the capture reagent through a specific binding reaction. The receptor molecule enables the indirect binding of the capture reagent to a solid support material before the performance of the assay or during the performance of the assay. The solid phase thus can be a plastic, derivatized plastic, magnetic or non-magnetic metal, glass or silicon surface of a test tube, microtiter well, sheet, bead, microparticle, chip, sheep (or other suitable animal's) red blood cells, duracytes and other configurations known to those of ordinary skill in the art. The polynucleotides of the invention can be attached to or immobilized on a solid support individually or in groups of at least 2, 5, 8, 10, 12, 15, 20, or 25 distinct polynucleotides of the invention to a single solid support. In addition, polynucleotides other than those of the invention may be attached to the same solid support as one or more polynucleotides of the invention.

The polynucleotides of the invention that are expressed or repressed in response to environmental stimuli such as, for example, stress or treatment with chemicals or pathogens or at different developmental stages can be identified by employing an array of nucleic acid samples, e.g., each sample having a plurality of oligonucleotides, and each plurality corresponding to a different plant gene, on a solid substrate, e.g., a DNA chip, and probes corresponding to nucleic acid expressed in, for example, one or more plant tissues and/or at one or more developmental stages, e.g., probes corresponding to nucleic acid expressed in seed of a plant relative to control nucleic acid from sources other than seed. Thus, genes that are upregulated or downregulated in the majority of tissues at a majority of developmental stages, or upregulated or downregulated in one tissue such as in seed, can be systematically identified. The probes may also correspond to nucleic acid expressed in response to a defined treatment such as, for example, a treatment with a variety of plant hormones or the exposure to specific environmental conditions involving, for example, an abiotic stress or exposure to light.

Specifically, labeled rice cRNA probes are hybridized to the rice DNA array, expression levels are determined by laser scanning and then rice genes are identified that had a particular expression pattern. The rice oligonucleotide probe array consists of probes from over 18,000 unique rice genes, which covers approximately 40-50% of the genome. This genome array permits a broader, more complete and less biased analysis of gene expression.

Consequently, the invention also deals with a method for detecting the presence of a polynucleotide including a nucleotide sequence which is substantially similar to a nucleotide sequence given in SEQ ID NOs: 1 to 567 provided in the Sequence Listing, and/or SEQ ID NOs: 569-623, and/or SEQ ID NOs: 625-671, and/or SEQ ID NOs: 673-825, or a fragment or a variant thereof, or a complementary sequence thereto, in a sample, the method including the following steps of:

(a) bringing into contact a nucleotide probe or a plurality of nucleotide probes which can hybridize with a polynucleotide having a nucleotide sequence which is substantially similar to a nucleotide sequence given in SEQ ID NOs: 1 to 567 provided in the Sequence Listing, and/or SEQ ID NOs: 569-623, and/or SEQ ID NOs: 625-671, and/or SEQ ID NOs: 673-825, a fragment or a variant thereof, or a complementary sequence thereto and the sample to be assayed.

(b) detecting the hybrid complex formed between the probe and a nucleotide in the sample.

The invention further concerns a kit for detecting the presence of a polynucleotide including a nucleotide sequence which is substantially similar to a nucleotide sequence given in SEQ ID NOs: 1 to 567 provided in the Sequence Listing, and/or SEQ ID NOs: 569-623, and/or SEQ ID NOs: 625-671, and/or SEQ ID NOs: 673-825, a fragment or a variant thereof, or a complementary sequence thereto, in a sample, the kit including a nucleotide probe or a plurality of nucleotide probes which can hybridize with a nucleotide sequence included in a polynucleotide, which nucleotide sequence is substantially similar to a nucleotide sequence given in of SEQ ID NOs: 1 to 567 provided in the Sequence Listing, and/or SEQ ID NOs: 569-623, and/or SEQ ID NOs: 625-671, and/or SEQ ID NOs: 673-825, a fragment or a variant thereof, or a complementary sequence thereto and, optionally, the reagents necessary for performing the hybridization reaction.

In a first preferred embodiment of this detection method and kit, the nucleotide probe or the plurality of nucleotide probes are labeled with a detectable molecule. In a second preferred embodiment of the method and kit, the nucleotide probe or the plurality of nucleotide probes has been immobilized on a substrate.

The isolated polynucleotides of the invention can be used to create various types of genetic and physical maps of the genome of rice or other plants. Such maps are used to devise positional cloning strategies for isolating novel genes from the mapped crop species. The sequences of the present invention are also useful for chromosome mapping, chromosome identification, tagging of $DIS^R$ genes.

The isolated polynucleotides of the invention can further be used as probes for identifying polymorphisms associated with phenotypes of interest such as, for example, disease resistance. Briefly, total DNA is isolated from an individual or isogenic line, cleaved with one or more restriction enzymes, separated according to mass, transferred to a solid support, and hybridized with a probe molecule according to the invention. The pattern of fragments hybridizing to a probe molecule is compared for DNA from different individuals or lines, where differences in fragment size signals a polymorphism associated with a particular nucleotide sequence according to the present invention. After identification of polymorphic sequences, linkage studies can be conducted. After identification of many polymorphisms using a nucleotide sequence according to the invention, linkage studies can be conducted by using the individuals showing polymorphisms as parents in crossing programs. Recombinants, $F_2$ progeny recombinants or recombinant inbreds, can then be analyzed using the same restriction enzyme/hybridization procedure. The order of DNA polymorphisms along the chromosomes can be inferred based on the frequency with which they are inherited together versus inherited independently. The closer together two polymorphisms occur in a chromosome, the higher the probability that they are inherited together. Integration of the relative positions of polymorphisms and associated marker sequences produces a genetic map of the species, where the distances between markers reflect the recombination frequencies in that chromosome segment. Preferably, the polymorphisms and marker sequences are sufficiently numerous to produce a genetic map of sufficiently high resolution to locate one or more loci of interest.

The use of recombinant inbred lines for such genetic mapping is described for rice (Oh et al., *Mol Cells* 8:175 (1998); Nandi et al., *Mol Gen Genet* 255:1 (1997); Wang et al., *Genetics* 136:1421 (1994)), sorghum (Subudhi et al., *Genome* 43:240 (2000)), maize (Burr et al., *Genetics* 118:519 (1998); Gardiner et al., *Genetics* 134:917 (1993)), and *Arabidopsis* (*Methods in Molecular Biology*, Martinez-Zapater and Salinas, eds., 82:137-146, (1998)). However, this procedure is not limited to plants and can be used for other organisms such as yeast or other fungi, or for oomycetes or other protistans.

The nucleotide sequences of the present invention can also be used for simple sequence repeat identification, also known as single sequence repeat, (SSR) mapping. SSR mapping in rice has been described by Miyao et al. (*DNA Res* 3:233 (1996)) and Yang et al. (*Mol Gen Genet* 245:187 (1994)), and in maize by Ahn et al. (*Mol Gen Genet* 241:483 (1993)). SSR mapping can be achieved using various methods. In one instance, polymorphisms are identified when sequence specific probes flanking an SSR contained within an sequence of the invention are made and used in polymerase chain reaction (PCR) assays with template DNA from two or more individuals or, in plants, near isogenic lines. A change in the number of tandem repeats between the SSR-flanking sequence produces differently sized fragments (U.S. Pat. No. 5,766,847). Alternatively, polymorphisms can be identified by using the PCR fragment produced from the SSR-flanking sequence specific primer reaction as a probe against Southern blots representing different individuals (Refseth et al., *Electrophoresis* 18:1519 (1997)). Rice SSRs are used to map a molecular marker closely linked to a nuclear restorer gene for fertility in rice as described by Akagi et al. (*Genome* 39:205 (1996)).

The nucleotide sequences of the present invention can be used to identify and develop a variety of microsatellite markers, including the SSRs described above, as genetic markers for comparative analysis and mapping of genomes. The nucleotide sequences of the present invention can be used in a variation of the SSR technique known as inter-SSR (ISSR), which uses microsatellite oligonucleotides as primers to amplify genomic segments different from the repeat region itself (Zietkiewicz et al., *Genomics*, 20:176 (1994)). ISSR employs oligonucleotides based on a simple sequence repeat anchored or not at their 5'- or 3'-end by two to four arbitrarily chosen nucleotides, which triggers site-specific annealing and initiates PCR amplification of genomic segments which are flanked by inversely orientated and closely spaced repeat sequences. In one embodiment of the present invention, microsatellite markers derived from the nucleotide sequences disclosed in the Sequence Listing, or substantially similar sequences or allelic variants thereof, may be used to detect the appearance or disappearance of markers indicating genomic instability as described by Leroy et al. *Electron. J. Biotechnol.*, 3(2):140-149 (2000)), where alteration of a fingerprinting pattern indicated loss of a marker corresponding to a part of a gene involved in the regulation of cell proliferation. Microsatellite markers derived from nucleotide sequences as provided in the Sequence Listing will be useful for detecting genomic alterations such as the change observed by Leroy et al. supra which appeared to be the consequence of microsatellite instability at the primer binding site or modification of the region between the microsatellites, and illustrated somaclonal variation leading to genomic instability. Consequently, the nucleotide sequences of the present invention are useful for detecting genomic alterations involved in somaclonal variation, which is an important source of new phenotypes.

In addition, because the genomes of closely related species are largely syntenic (that is, they display the same ordering of genes within the genome), these maps can be used to isolate novel alleles from wild relatives of crop species by positional cloning strategies. This shared synteny is very powerful for using genetic maps from one species to map genes in another. For example, a gene mapped in rice provides information for the gene location in maize and wheat.

The various types of maps discussed above can be used with the nucleotide sequences of the invention to identify Quantitative Trait Loci (QTLs) for a variety of uses, including marker-assisted breeding. Many important crop traits are quantitative traits and result from the combined interactions of several genes. These genes reside at different loci in the genome, often on different chromosomes, and generally exhibit multiple alleles at each locus. Developing markers, tools, and methods to identify and isolate the QTLs involved in disease resistance, enables marker-assisted breeding to enhance disease resistance in plants or suppress undesirable traits that interfere with the plants defense mechanisms. The nucleotide sequences as provided in the Sequence Listing can be used to generate markers, including single-sequence repeats (SSRs) and microsatellite markers for QTLs involved in disease resistance to assist marker-assisted breeding. The nucleotide sequences of the invention can be used to identify QTLs involved in disease resistance and isolate alleles as described by Li et al. in a study of QTLs involved in resistance to a pathogen of rice. (Li et al., *Mol Gen Genet* 261:58 (1999)). In addition to isolating QTL alleles in rice, other cereals, and other monocot and dicot crop species, the nucleotide sequences of the invention can also be used to isolate alleles from the corresponding QTL(s) of wild relatives. Transgenic plants having various combinations of QTL alleles can then be created and the effects of the combinations measured. Once an ideal allele combination has been identified, crop improvement can be accomplished either through biotechnological means or by directed conventional breeding programs. (Flowers et al., *J Exp Bot* 51:99 (2000); Tanksley and McCouch, *Science* 277:1063 (1997)).

In another embodiment the nucleotide sequences of the invention can be used to help create physical maps of the genome of maize, *Arabidopsis* and related species. Where the nucleotide sequences of the invention have been ordered on a genetic map, as described above, then the nucleotide sequences of the invention can be used as probes to discover which clones in large libraries of plant DNA fragments in YACs, PACs, etc. contain the same nucleotide sequences of the invention or similar sequences, thereby facilitating the assignment of the large DNA fragments to chromosomal positions. Subsequently, the large BACs, YACs, etc. can be ordered unambiguously by more detailed studies of their sequence composition and by using their end or other sequence to find the identical sequences in other cloned DNA fragments (Mozo et al., *Nat Genet* 22:271 (1999)). Overlapping DNA sequences in this way allows assembly of large sequence contigs that, when sufficiently extended, provide a complete physical map of a chromosome. The nucleotide sequences of the invention themselves may provide the means of joining cloned sequences into a contig, and are useful for constructing physical maps.

In another embodiment, the nucleotide sequences of the present invention may be useful in mapping and characterizing the genomes of other cereals. Rice has been proposed as a model for cereal genome analysis (Havukkala, *Curr Opin Genet Devel* 6:711 (1996)), based largely on its smaller genome size and higher gene density, combined with the considerable conserved gene order among cereal genomes (Ahn et al., *Mol Gen Genet* 241:483 (1993)). The cereals demonstrate both general conservation of gene order (synteny) and considerable sequence homology among various cereal gene families. This suggests that studies on the functions of genes or proteins from rice involved in disease resistance could lead to elucidation of the functions of orthologous genes or proteins in other cereals, including maize, wheat, secale, sorghum, barley, millet, teff, milo, triticale, flax, gramma grass, *Tripsacum* sp., and teosinte. The nucleotide sequences according to the invention can also be used to physically characterize homologous chromosomes in other cereals, as described by Sarma et al. (*Genome* 43:191 (2000)), and their use can be extended to non-cereal monocots such as sugarcane, grasses, and lilies.

Given the synteny between rice and other cereal genomes, the nucleotide sequences of the present invention can be used to obtain molecular markers for mapping and, potentially, for positional cloning. Kilian et al. described the use of probes from the rice genomic region of interest to isolate a saturating number of polymorphic markers in barley, which are shown to map to syntenic regions in rice and barley, suggesting that the nucleotide sequences of the invention derived from the rice genome would be useful in positional cloning of syntenic genes of interest from other cereal species that are involved in disease resistance. (Kilian, et al., *Nucl Acids Res* 23:2729 (1995); Kilian, et al., *Plant Mol Biol* 35:187 (1997)). Synteny between rice and barley has recently been reported in the area of the carying malting quality QTLs (Han, et al., *Genome* 41:373 (1998)), and use of synteny between cereals for positional cloning efforts is likely to add considerable value to rice genome analysis. Likewise, mapping of the ligules region of sorghum is facilitated using molecular markers from a syntenic region of the rice genome. (Zwick, et al., *Genetics* 148:1983 (1998)).

Rice marker technology utilizing the nucleotide sequences of the present invention can also be used to identify QTL alleles for enhanced disease resistance from a wild relative of cultivated rice, for example as described by xiao, et al. (*Genetics* 150:899 (1998)). Wild relatives of domesticated plants represent untapped pools of genetic resources for abiotic and biotic stress resistance, apomixis and other breeding strategies, plant architecture, determinants of yield, secondary metabolites, and other valuable traits. In rice, xiao et al. (supra) used molecular markers to introduce an average of approximately 5% of the genome of a wild relative, and the resulting plants are scored for phenotypes such as plant height, panicle length and 1000-grain weight Trait-improving alleles are found for all phenotypes except plant height, where any change is considered negative. Of the 35 trait-improving alleles, Xiao et al. found that 19 had no effect on other phenotypes whereas 16 had deleterious effects on other traits. The nucleotide sequences of the invention such as those provided in the Sequence Listing can be employed as molecular markers to identify QTL alleles for enhanced disease resistance from a wild relative, by which these valuable traits can be introgressed from wild relatives using methods including, but not limited to, that described by Xiao et al. ((1998) supra). Accordingly, the nucleotide sequences of the invention can be employed in a variety of molecular marker technologies for yield improvement.

Following the procedures described above to identify polymorphisms, and using a plurality of the nucleotide sequences of the invention, any individual (or line) can be genotyped. Genotyping a large number of DNA polymorphisms such as single nucleotide polymorphisms (SNPs), in breeding lines makes it possible to find associations between certain polymorphisms or groups of polymorphisms, and certain phenotypes. In addition to sequence polymorphisms, length polymorphisms such as triplet repeats are studied to find associations between polymorphism and phenotype. Genotypes can be used for the identification of particular cultivars, varieties, lines, ecotypes, and genetically modified plants or can serve as tools for subsequent genetic studies of complex traits involving multiple phenotypes.

The patent publication WO95/35505 and U.S. Pat. Nos. 5,445,943 and 5,410,270 describe scanning multiple alleles of a plurality of loci using hybridization to arrays of oligonucleotides. The nucleotide sequences of the invention are suitable for use in genotyping techniques useful for each of the types of mapping discussed above.

In a preferred embodiment, the nucleotide sequences of the invention are useful for identifying and isolating a least one unique stretch of protein-encoding nucleotide sequence. The nucleotide sequences of the invention are compared with other coding sequences having sequence similarity with the sequences provided in the Sequence Listing, using a program such as BLAST. Comparison of the nucleotide sequences of the invention with other similar coding sequences permits the identification of one or more unique stretches of coding sequences encoding proteins that are involved in disease resistance, and that are not identical to the corresponding coding sequence being screened. Preferably, a unique stretch of coding sequence of about 25 base pairs (bp) long is identified, more preferably 25 bp, or even more preferably 22 bp, or 20 bp, or yet even more preferably 18 bp or 16 bp or 14 bp. In one embodiment, a plurality of nucleotide sequences is screened to identify unique coding sequences according to the invention. In one embodiment, one or more unique coding sequences according to the invention can be applied to a chip as part of an array, or used in a non-chip array system. In a further embodiment, a plurality of unique coding sequences according to the invention is used in a screening array. In another embodiment, one or more unique coding sequences according to the invention can be used as immobilized or as probes in solution. In yet another embodiment, one or more unique coding sequences according to the invention can be used as primers for PCR. In a further embodiment, one or more unique coding sequences according to the invention can be used as organism-specific primers for PCR in a solution containing DNA from a plurality of sources.

In another embodiment unique stretches of nucleotide sequences according to the invention are identified that are preferably about 30 bp, more preferably 50 bp or 75 bp, yet more preferably 100 bp, 150 bp, 200 bp, 250, 500 bp, 750 bp, or 1000 bp. The length of an unique coding sequence may be chosen by one of skill in the art depending on its intended use and on the characteristics of the nucleotide sequence being used. In one embodiment, unique coding sequences according to the invention may be used as probes to screen libraries to find homologs, orthologs, or paralogs. In another embodiment, unique coding sequences according to the invention may be used as probes to screen genomic DNA or cDNA to find homologs, orthologs, or paralogs. In yet another embodiment, unique coding sequences according to the invention may be used to study gene evolution and genome evolution.

The invention also provides a computer readable medium having stored thereon a data structure containing nucleic acid sequences having at least 70% sequence identity to a nucleic acid sequence selected from the $DIS^R$ sequences of the invention, as well as complementary, ortholog, and variant sequences thereof. Storage and use of nucleic acid sequences on a computer readable medium is well known in the art. (See for example U.S. Pat. Nos. 6,023,659; 5,867,402; 5,795,716) Examples of such medium include, but are not limited to, magnetic tape, optical disk, CD-ROM, random access memory, volatile memory, non-volatile memory and bubble memory. Accordingly, the nucleic acid sequences contained on the computer readable medium may be compared through use of a module that receives the sequence information and compares it to other sequence information. Examples of other sequences to which the nucleic acid sequences of the invention may be compared include those maintained by the National Center for Biotechnology Information (NCBI) and the Swiss Protein Data Bank. A computer is an example of such a module that can read and compare nucleic acid sequence information. Accordingly, the invention also provides the method of comparing a nucleic acid sequence of the invention to another sequence. For example, a sequence of the invention may be submitted to the NCBI for a Blast search as described herein where the sequence is compared to sequence information contained within the NCBI database and a comparison is returned. The invention also provides nucleic acid sequence information in a computer readable medium that allows the encoded polypeptide to be optimized for a desired property. Examples of such properties include, but are not limited to, increased or decreased: thermal stability, chemical stability, hydrophilicity, hydrophobicity, and the like. Methods for the use of computers to model polypeptides and polynucleotides having altered activities are well known in the art and have been reviewed (Lesyng et al., 1993; Surles et al., 1994; Koehl et al., 1996; Rossi et al., 2001).

EXAMPLES

The invention will be further described by reference to the following detailed examples. These examples are provided for purposes of illustration only, and are not intended to be limiting unless otherwise specified. Standard recombinant DNA and molecular cloning techniques used here are well known in the art and are described in detail in Sambrook et al. (*Molecular Cloning: A Laboratory Manual*, Cold Spring Harbor Laboratory Press (1989)) and by Ausubel et al. (*Current Protocols in Molecular Biology*, Greene Publishing (1992)).

Example 1

Rice Orthologs of *Arabidopsis* Genes that Regulate Disease Resistance Responses

*Arabidopsis thaliana* genes that are important for control of disease resistance responses based on the altered disease resistance phenotype of plants with mutations in these genes are used to identify orthologous rice genes using BLAST sequence similarity searching. Table 1 provides a list of those *Arabidopsis* genes, rice genomic identifier numbers and the *SEQ ID number for the rice genes corresponding to the *Arabidopsis* gene.

TABLE 1

| Known Gene Name | AGI number | Reference | Rice DNA *SEQ ID NO: | Rice Protein *SEQ ID NO: |
|---|---|---|---|---|
| PAD4 | At3g52430 | Jirage et al., 1999 | 69037 | 69038 |
| EDS1 | At3g48090 | Falk et al., 1999 | 150143 | 150144 |
| NPR1/NIM1 | At1g64280 | Cao et al., 1997 | | |
| RAR1/PBS2 | At5g51700 | Shirasu et al., 1999 | 150147 | 150148 |
| EDS5 | At4g39030 | Nawrath and Metraux, 1999 | | |
| SID2 | At1g74710 | Nawrath and Metraux, 1999 | 150081 | 150082 |

TABLE 1-continued

| Known Gene Name | AGI number | Reference | Rice DNA *SEQ ID NO: | Rice Protein *SEQ ID NO: |
|---|---|---|---|---|
| LSD1 | At4g20380 | Dietrich et al., 1997 | 150135 | 150136 |
| | | | 150139 | 150140 |
| COI1 | At2g39940 | Xie et al., 1998 | 150149 | 150150 |
| | | | 150137 | 150138 |
| NDR1 | At3g20600 | Century et al., 1997 | 150141 | 150142 |
| SGT1 | At4g11260 At4g23570 | Austin et al., 2002 | 150145 | 150146 |

[1] In descending order from most similar to least similar

See also *SEQ ID NOs:8539, 10047, 22073, 22945, 30015, 30017, 30019, 31553, 58035, 69037, 73647, 77041, 89655, 97491, 150135, 150137, 150139, 150141, 150143, 150145, 150147, 150149, and 150081 which encode *SEQ ID NOs:8540, 10048, 22074, 22946, 30016, 30018, 30020, 31554, 58036, 69038, 73648, 77042, 89655, 97492, 150136, 150138, 150140, 150142, 150144, 150146, 150148, 150150, and 150082, respectively.

Example 2

Rice Orthologs of *Arabidopsis* Disease Resistance Genes Identified by Reverse Genetics Understanding the function of every gene is the major challenge in the age of completely sequenced eukaryotic genomes. Sequence homology can be helpful in identifying possible functions of many genes. However, reverse genetics, the process of identifying the function of a gene by obtaining and studying the phenotype of an individual containing a mutation in that gene, is another approach to identify the function of a gene.

Reverse genetics in *Arabidopsis* has been aided by the establishment of large publicly available collections of insertion mutants (Krysan et al., 1999; Tisser et al., 1999; Speulman et al., 1999; Parinov et al., 1999; Parinov and Sundaresan, 2000; Sussman et al., 2000). Mutations in genes of interest are identified by screening the population by PCR amplification using primers derived from sequences near the insert border and the gene of interest to screen through large pools of individuals. Pools producing PCR products are confirmed by Southern hybridization and further deconvoluted into subpools until the individual is identified (Sussman et al., 2000).

Recently, some groups have begun the process of sequencing insertion site flanking regions from individual plants in large insertion mutant populations, in effect prescreening a subset of lines for genomic insertion sites (Parinov et al., 1999; Tisser et al., 1999). The advantage to this approach is that the laborious and time-consuming process of PCR-based screening and deconvolution of pools is avoided.

A large database of insertion site flanking sequences from approximately 100,000 T-DNA mutagenized *Arabidopsis* plants of the Columbia ecotype (GARLIC lines) is prepared. T-DNA left border sequences from individual plants are amplified using a modified thermal asymmetric interlaced-polymerase chain reaction (TAIL-PCR) protocol (Liu et al., 1995). Left border TAIL-PCR products are sequenced and assembled into a database that associates sequence tags with each of the approximately 100,000 plants in the mutant collection. Screening the collection for insertions in genes of interest involves a simple gene name or sequence BLAST query of the insertion site flanking sequence database, and search results point to individual lines. Insertions are confirmed using PCR.

Analysis of the GARLIC insert lines suggests that there are 76,856 insertions that localize to a subset of the genome representing coding regions and promoters of 22,880 genes. Of these, 49,231 insertions lie in the promoters of over 18,572 genes, and an additional 27,625 insertions are located within the coding regions of 13,612 genes. Approximately 25,000 T-DNA left border mTAIL-PCR products (25% of the total 102,765) do not have significant matches to the subset of the genome representing promoters and coding regions, and are therefore presumed to lie in noncoding and/or repetitive regions of the genome.

Results

The *Arabidopsis* T-DNA GARLIC insertion collection is used to investigate the roles of certain genes in disease resistance. Target genes are chosen using a variety of criteria, including public reports of enhanced disease susceptibility phenotypes, induced expression in response to infection from profiling experiments, and sequence similarity to genes implicated in disease resistance. Plant lines with insertions in genes of interest are then identified. Each T-DNA insertion line is represented by a seed lot collected from a plant that is hemizygous for a particular T-DNA insertion. Plants homozygous for insertions of interest are identified using a PCR assay. The seed produced by these plants is homozygous for the T-DNA insertion mutation of interest.

Homozygous mutant plants are tested for altered disease resistance. At least 16 plants from each line are infected with the bacterial pathogen *Pseudomonas syringae* pv. *maculicola* strain ES4326 (PsmES4326) at a concentration of 1,000 cfu/$cm^2$ of leaf. Wild-type and pad4 mutant plants are used as controls. Plants with pad4 mutations display an enhanced disease susceptibility phenotype. After three days, bacterial titers in infected leaves are assayed. Leaf discs are cut from infected leaves, ground in 10 mM $MgSO_4$, diluted in serial 10-fold dilutions, and plated on nutrient medium. After two days, colony counts are determined and bacterial titers are calculated. Insertion mutants that displayed significantly higher bacterial titers than wild-type plants are judged to have enhanced susceptibility phenotypes. The genes interrupted in these mutants contribute to disease resistance. Insertion mutants that displayed significantly lower bacterial titers than wild-type plants are judged to have enhanced resistance phenotypes. The genes interrupted in these mutants interfere with disease resistance.

Rice orthologs of the *Arabidopsis* genes affecting disease resistance are identified by similarity searching of a rice database using the Double-Affine Smith-Waterman algorithm (BLASP with e values better than $^{-10}$). The results are shown in Table 2.

TABLE 2

| AGI# | T-DNA line | Description | Disease Assay | Rice DNA *SEQ ID NO. | Rice Protein *SEQ ID NO. |
|---|---|---|---|---|---|
| At1g01480 | 349_H09 | ACC synthase | S | 150051 | 150052 |
| At1g04280 | 1265_A02 | histone H1-1flk | S | | |
| At1g100040 | 839_C04 | unknown protein | S | 15007 | 15008 |
| At1g32170 | 573_B03 | Endoxyloglucan transferase, putative | S | 89655 | 89656 |
| At1g43160 | 1225_G09 | RAP2.6 | S | | |
| At1g66700 | 875_G02 | methyltransferase, putative | R | 150117 | 150118 |
| At1g70250 | 900_E10 | Receptor serine/threonine kinase, putative | S | | |
| At1g74710 | 112_G09 | SID2 | S | 150081 | 150082 |
| At1g77760 | 656_G01 | NR1 Nitrate reductase | S | 150127 | 150128 |
| At2g24550 | 552_G05 | unknown protein | S | | |
| At2g39220 | 830_G12 | similar to latex allergen from Hevea brasiliensis | S | | |
| At2g44200 | 412_D06 | unknown protein | S | | |
| At2g44790 | 898_H11 | Phytocyanin | S | 150077 | 150078 |
| At2g47550 | 68_A05 | Pectinesterase, putative | S | 150079 | 150080 |
| At3g04720 | 239_G07 | PR-4 chitin-binding protein, putative | S | 30019 | 30020 |
| At3g28940 | 549_H09 | AIG2-like | S | 8539 | 8540 |
| At3g48080 | 676_F07 | EDS1 duplicate | S | 69037 | 69038 |
| At3g49120 | 895_G10 | Peroxidase | S | 22945 | 22946 |
| At4g25880 | 127_A07 270_D02 | pumilio-like | S | 135197 | 135198 |
| At4g29990 | 383_F05 | Receptor serine/threonine kinase, putative | S | 10047 | 10048 |
| At4g39030 | 1255_E09 | EDS5 | S | | |
| At5g01600 | 312_A02 | Ferritin | R | 43055 | 43056 |
| At5g64930 | 639_D08 | CPR5 | R | 97491 | 97492 |
| At1g61370 | 857_E06 | Receptor serine/threonine kinase, putative | S | 150091 | 150092 |
| At1g61430 | 851_A03 | Receptor serine/threonine kinase, putative | S | 58035 | 58036 |
| At3g44300 | 681_H09 | nitrilase 2 | S | 73647 | 73648 |
| At4g23220 | 279_G09 | serine/threonine kinase-like protein | S | 22073 | 22074 |
| At5g04340 | 58_E04 | c2h2zinc finger transcription factor, putative | S | 150069 | 150070 |
| At5g19010 | 330_E01 | 45-MAP kinase-like protein | R | | |
| At1g73500 | 60_H06 | 18-MAP kinase-like protein | S | 150073 | 150074 |
| At1g18150 | 1221_F01 | 14-MAP kinase-like protein | R | | |
| At4g01870 | 135_E04 | unknown protein | S | 45397 | 45398 |
| At4g37430 | 1148_A04 | Cytochrome P450 monooxygenase CYP91A2 | S | | |

"AGI#": Identifier for the *Arabidopsis* gene assigned by the *Arabidopsis* Genome Initiative; "T-DNA line": Identifier for a seed line in the GARLIC collection; "Description": Description of the *Arabidopsis* gene; "Rice Orthologs": Rice genes most similar to the *Arabidopsis* genes. If multiple rice genes are similar, only the most similar is shown. If several rice genes are equally similar, they are all shown. If it is not possible to identify an ortholog, or a large number of equally similar orthologs are found, the line is left blank, "Disease Assay": "S" indicates mutant plants are more susceptible to PsmES4326, "R" indicates mutant plants are more resistant to PsmES4326.

See also *SEQ ID NOs:8539, 10047, 22073, 22945, 30015, 30017, 30019, 31553, 43055, 45397, 58035, 69037, 73647, 77041, 89655, 97491, 135197, 150007, 150015, 150041, 150051, 150069, 150073, 150077, 150079, 150081, 150091, 150109, 150117, 150127, and 150133, which encode *SEQ ID NOs:8540, 10048, 22074, 22946, 30016, 30018, 30020, 31554, 43056, 45398, 58036, 69038, 73648, 77042, 89655, 97492, 135198, 150008, 150016, 150042, 150052, 150070, 150074, 150078, 150080, 150082, 150092, 150110, 150118, 150128, and 150133, respectively.

Example 3

Functional Complementation Assay 3.1. Materials and Methods 3.1.1 Preparation of DNA. Plant genomic DNA samples are isolated from frozen tissues, according to one of the three procedures, e.g., standard procedures described by Ausubel et al. (1995), a quick leaf prep described by Klimyuk et al. (1993), or using FTA paper (Life Technologies). For the latter procedure, a piece of leaf is excised from the plant, placed on top of the FTA paper and covered with a small piece of parafilm that serves as a barrier material to prevent contamination of the crushing device. In order to drive the sap and cells from the plant tissue into the FTA paper matrix for effective cell lysis and nucleic acid entrapment, a crushing device is used to mash the tissue into the FTA paper. The FTA paper is air dried for an hour. For analysis of DNA, the samples can be archived on the paper until analysis. Two mm punches are removed from the specimen area on the FTA paper using a 2 mm Harris Micro Punch™ and placed into PCR tubes. Two hundred (200) microliters of FTA purification reagent is added to the tube containing the punch and vortexed at low speed for 2 seconds. The tube is then incubated at room temperature for 5 minutes. The solution is removed with a pipette so as to repeat the wash one more time. Two hundred (200) microliters of TE (10 mM Tris, 0.1 mM EDTA, pH 8.0) is added and the wash is repeated two more times. The PCR mix is added directly to the punch for subsequent PCR reactions.

3.1.2 DNA sequencing. DNA sequencing is performed using standard dye-terminator sequencing procedures and automated sequencers (models 373 and 377; Applied Biosystems, Foster City, Calif.). The DNA sequences are analyzed using DNAstar software for designing polymorphic markers between Columbia and Landsberg ecotypes. For comparing the DNA sequence in the mapped interval containing the DIS$^R$ gene, the DNA sequences from the corresponding mutant plant and the wild type sequence from the genomic sequencing projects are compared using the PHRED/PHRAP alignment program.

3.1.3 Construction of Gateway Destination Vector pNOVMCS118GW Plant transformation vector pNOVMCS-Pactin is converted into a Gateway destination vector. The vector pNOVMCS-Pactin is linearized by the restriction enzyme SmaI. and converted to a Gateway cloning vector by cloning the blunt-end Gateway cassette into it. The cassette is flanked by attR sites, which enables any DNA fragment to be cloned into the vector by recombination, in a specific orientation.

The cassette contains an attR1 site at the 5'end, the chloramphenicol resistance gene, the ccdB gene, and the attR2 site at the 3'end. The chloramphenicol antibiotic is used as a positive selection marker for the plasmid containing the Gateway cassette. The ccdB gene is used as a negative selectable marker against plasmids that have not undergone a recombination event. The ccdB gene is used to interfere with the DNA gyrase enzyme in *E. coli* and destabilizes the DNA structure. The plasmid containing the Gateway cassette with the ccdB gene is lethal to most common *E. coli* strains. Hence the destination vector has to be constructed and propagated in DB3.1 cells, a gyrA462 strain which is resistant to the ccdB protein.

3.1.4 Plant Transformation. Plasmid pNOVMCS118GW containing the cloned DNA fragment with the putative DIS$^R$ gene is constructed using the Gateway recombination technology from Life Technologies. The primers used to isolate the DNA spanning the DIS$^R$ gene by PCR are:

```
                                     (*SEQ ID NO: 1391)
16.60F:  5'GWFTCATTTCCTGGTCCTCTGTAGAAGATAGCT 3'

(*SEQ IDNO: 1392)
16.60R:  5'GWRCCGTTGGTGGGCTTCAAATGAGGTCTAAAG 3',
``` where GWF and GWR indicate the forward and reverse modifications for Gateway primers. The plasmid is introduced into *Agrobacterium tumefaciens* GV3101pMP90 (Koncz, C., and Schell, J. (1986). Mol Gen Genet 204, 383-396.) by electroporation. The positive bacterial transformants are selected on LB medium containing 50 µg/µl kanamycin and 25 µg/µl gentamycin. *Arabidopsis* plants are transformed by standard methodology (e.g., by dipping flowers into a solution containing the *Agrobacterium*; see Clough, S. J., and Bent, A. F. (1998) Plant J 16, 735-743) except that 0.02% Silwet-77 (Lehle Seeds, Round Rock, Tex.) is added to the bacterial suspension and the vacuum step is omitted. Five hundred (500) mg of seeds are planted per 2 ft$^2$ flat of soil and plant transformants are selected by spraying with the herbicide formulated BASTA (2 ml of Finale, AgrEvo Environmental Health, Montvale, N.J., is added to 498 ml water) once every two days, for a week.

3.2 Results

A BLAST search of the GenBank database revealed that the sequence of At4g23360(16G20.60) is similar to other predicted unknown genes in the *Arabidopsis* genome, but not to any other gene that encodes a protein of a known function. The greatest homology of this gene is observed to other genes in the region adjacent to this gene, such as At4g23370 and At4g23350. The structure of the predicted DIS$^R$ protein consists entirely of two repeats of an amino acid sequence which are 95% identical. It is likely that the DIS$^R$ gene corresponds to a sequence encoding the first repeat.

To confirm that the DIS$^R$ gene lies in the region identified, a complementation construct spanning the predicted gene At4g23360 (16G20.60), is prepared using the recombination-based Gateway™ technology. In the construct, 1.3 kb of upstream and 0.8 kb of downstream sequence is included since the exact start and stop sites for the gene are not evident from the public sequence. The length of the cloned piece of DNA is 5.879 kb. The construct is cloned into the plant transformation vector pNOVMCS118GW, which contains a resistance gene for the herbicide BASTA. The vector containing the DIS$^R$ gene and a control (empty) vector without the gene are used to transform mutant plants. The first generation of positive transformants, T1, are selected on soil using the herbicide BASTA. After four weeks, the plants are infected with virulent PsmES4326 and ten tested for camalexin synthesis. The transformant pDest+16G20.60(1) which had the genomic construct showed 10-fold higher levels of camalexin than corresponding transformants with the empty vector. A second transformant, pDest+16G20.60(2), showed 2.3-fold higher levels of camalexin than corresponding transformants with the empty vector. The pDest+16G20.60(2) plant is smaller, had shriveled leaves, and appeared stressed compared to the other plants. The mutant plant normally shows 10% to 20% of the wild type level of camalexin after infection. Hence, the camalexin deficient phenotype in the mutant plant is complemented by expression of the genomic DNA construct.

3.3 An alternative approach to that described in Example 3.1 above can be used for the functional characterization of the DIS$^R$ genes in plants. Plant deletion mutants that are impaired in their disease defense strategy can be complemented by the respective rice gene.

Rice and *Arabidopsis* putative orthologue pairs are identified using BLAST comparisons, TFASTXY comparisons, and Double-Affine Smith-Waterman similarity searches. Constructs containing a rice cDNA or genomic clone inserted between the promoter and terminator of the *Arabidopsis* orthologue are generated using overlap PCR (Gene 77, 61-68 (1989)) and GATEWAY cloning (Life Technologies Invitrogen). For ease of cloning, rice cDNA clones are preferred to rice genomic clones. A three stage PCR strategy is used to make these constructs.

(1) In the first stage, primers are used to PCR amplify: (i) 2 Kb upstream of the translation start site of the *Arabidopsis* orthologue, (ii) the coding region or cDNA of the rice orthologue, and (iii) the 500 bp immediately downstream of the Arabidopsis orthogue's translation stop site. Primers are designed to incorporate onto their 5' ends at least 16 bases of the 3' end of the adjacent fragment, except in the case of the most distal primers which flank the gene construct (the forward primer of the promoter and the reverse primer of the terminator). The forward primer of the promoters contains on their 5' ends partial AttB1 sites, and the reverse primer of the terminators contains on their 5' ends partial AttB2 sites, for Gateway cloning.

(2) In the second stage, overlap PCR is used to join either the promoter and the coding region, or the coding region and the terminator.

(3) In the third stage either the promoter-coding region product can be joined to the terminator or the coding region-terminator product can be joined to the promoter, using overlap PCR and amplification with full Att site-containing primers, to link all three fragments, and put full Att sites at the construct termini.

The fused three-fragment pieces flanked by Gateway cloning sites are introduced into the LTI donor vector pDONR201 (Invitrogen) using the BP clonase reaction, for confirmation by sequencing. Confirmed sequenced constructs are introduced into a binary vector containing Gateway cloning sites, using the LR clonase reaction such as, for example, pAS200.

The pAS200 vector was created by inserting the Gateway cloning cassette RfA into the Acc65I site of pNOV3510.

pNOV3510 was created by ligation of inverted pNOV2114 VSI binary into pNOV3507, a vector containing a PTX5' Arab Protox promoter driving the PPO gene with the Nos terminator.

pNOV2114 was created by insertion of virGN54D (Pazour et al. 1992, J. Bacteriol. 174:4169-4174) from pAD1289 (Hansen et al. 1994, PNAS 91:7603-7607) into pHiNK085.

pHiNK085 was created by deleting the 35S:PMI cassette and M13 ori in pVictorHiNK.

pPVictorHiNK was created by modifying the T-DNA of pVictor (described in WO 97/04112) to delete M13 derived sequences and to improve its cloning versatility by introducing the BIGLINK polylinker.

The sequence of the pVictor HiNK vector is disclosed in SEQ ID NO: 5 in WO 00/6837, which is incorporated herein by reference. The pVictorHiNK vector contains the following constituents that are of functional importance:

The origin of replication (ORI) functional in *Agrobacterium* is derived from the *Pseudomonas aeruginosa* plasmid pVS1 (Itoh et al. 1984. Plasmid 11: 206-220; Itoh and Haas, 1985. Gene 36: 27-36). The pVS1 ORI is only functional in *Agrobacterium* and can be mobilised by the helper plasmid pRK2013 from *E. coli* into *A. tumefaciens* by means of a triparental mating procedure (Ditta et al., 1980. Proc. Natl. Acad. Sci USA 77: 7347-7351).

The ColE1 origin of replication functional in *E. coli* is derived from pUC19 (Yannisch-Perron et al., 1985. Gene 33: 103-119).

The bacterial resistance to spectinomycin and streptomycin encoded by a 0.93 kb fragment from transposon Tn7 (Fling et al., 1985. Nucl. Acids Res. 13: 7095) functions as selectable marker for maintenance of the vector in *E. coli* and *Agrobacterium*. The gene is fused to the tac promoter for efficient bacterial expression (Amman et al., 1983. Gene 25: 167-178).

The right and left T-DNA border fragments of 1.9 kb and 0.9 kb that comprise the 24 bp border repeats, have been derived from the Ti-plasmid of the nopaline type *Agrobacterium tumefaciens* strains pTiT37 (Yadav et al., 1982. Proc. Natl. Acad. Sci. USA. 79: 6322-6326).

The plasmid is introduced into *Agrobacterium tumefaciens* GV3101pMP90 by electroporation. The positive bacterial transformants are selected on LB medium containing 50 μg/μl kanamycin and 25 μg/μl gentamycin. Plants are transformed by standard methodology (e.g., by dipping flowers into a solution containing the *Agrobacterium*) except that 0.02% Silwet-77 (Lehle Seeds, Round Rock, Tex.) is added to the bacterial suspension and the vacuum step omitted. Five hundred (500) mg of seeds are planted per 2 ft$^2$ flat of soil and, and progeny seeds are selected for transformants using PPO selection.

Primary transformants are analyzed for complementation. Primary transformants are genotyped for the *Arabidopsis* mutation and presence of the transgene. When possible, >50 mutants harboring the transgene should be phenotyped to observe variation due to transgene copy number and expression Example 4

GeneChip Standard Protocol

Quantitation of Total RNA
    Total RNA from plant tissue is extracted and quantified.
    1. Quantify total RNA using GeneQuant
    1 OD$_{260}$=40 mg RNA/ml; A260/A280=1.9 to about 2.1
    2. Run gel to check the integrity and purity of the extracted RNA Synthesis of Double-Stranded cDNA
    Gibco/BRL SuperScript Choice System for cDNA Synthesis (Cat#1B090-019) is employed to prepare cDNAs. T7-(dT)$_{24}$ oligonucleotides are prepared and purified by HPLC. (5'-GGCCAGTGAATTGTAATACGACTCACTATAGGGAGG-CGG-(dT)$_{24}$-3' *SEQ ID NO:1394).
    Step 1. Primer Hybridization:
    Incubate at 70° C. for 10 minutes
    Quick spin and put on ice briefly
    Step 2. Temperature Adjustment:
    Incubate at 42° C. for 2 minutes
    Step 3. First Strand Synthesis:
    DEPC-water—1 μl
    RNA (10 μg final)—10 μl
    T7=(dT)$_{24}$ Primer (100 pmol final)—1 μl pmol
    5× 1st strand cDNA buffer—4 μl
    0.1M DTT (10 mM final)—2 μl
    10 mM dNTP mix (500 μM final)—1 μl
    Superscript II RT 200 U/μl—1 μl
    Total of 20 μl
    Mix well Incubate at 42° C. for 1 hour
Step 4. Second Strand Synthesis:
Place reactions on ice, quick spin
DEPC-water—91 µl
5× 2nd strand cDNA buffer—30 µl
mM dNTP mix (250 mM final)—3 µl
E. coli DNA ligase (10 U/µl)—1 µl
E. coli DNA polymerase 1-10 U/µl—4 µl
RnaseH 2 U/µl—1 µl
T4 DNA polymerase 5 U/µl—2 µl
0.5 M EDTA (0.5 M final)—10 µl
Total 162 µl
Mix/spin down/incubate 16° C. for 2 hours
Step 5. Completing the Reaction:
Incubate at 16° C. for 5 minutes Purification of Double Stranded cDNA
1. Centrifuge PLG (Phase Lock Gel, Eppendorf 5 Prime, Inc., PI-188233) at 14,000×, transfer 162 µl of cDNA to PLG
2. Add 162 µl of Phenol:Chloroform:Isoamyl alcohol (pH 8.0), centrifuge 2 minutes
3. Transfer the supernatant to a fresh 1.5 ml tube, add

| Glycogen (5 mg/ml) | 2 |
| 0.5 M NH$_4$OAC (0.75×Vol) | 120 |
| ETOH (2.5×Vol, −20 C.) | 400 |

4. Mix well and centrifuge at 14,000× for 20 minutes
5. Remove supernatant, add 0.5 ml 80% EtOH (−20° C.)
6. Centrifuge for 5 minutes, air dry or by speed vac for 5-10 minutes
7. Add 44 µl DEPC H$_2$O Analyze of quantity and size distribution of cDNA
Run a gel using 1 µl of the double-stranded synthesis product Synthesis of Biotinylated cRNA
(use Enzo BioArray High Yield RNA Transcript Labeling Kit Cat#900182)

| Purified cDNA | 22 µl |
| 10X Hy buffer | 4 µl |
| 10X biotin ribonucleotides | 4 µl |
| 10X DTT | 4 µl |
| 10X Rnase inhibitor mix | 4 µl |
| 20X T7 RNA polymerase | 2 µl |
| Total | 40 µl |

Centrifuge 5 seconds, and incubate for 4 hours at 37EC
Gently mix every 30-45 minutes Purification and Quantification of cRNA
(use Qiagen Rneasy Mini kit Cat#74103)
Determine concentration and dilute to 1 µg/µl concentration Fragmentation of cRNA

| cRNA (1 µg/µl) | 15 µl |
| 5X Fragmentation Buffer* | 6 µl |
| DEPC H$_2$O | 9 µl |
| | 30 µl |

*5X Fragmentation Buffer

| 1M Tris (pH 8.1) | 4.0 ml |
| MgOAc | 0.64 g |
| KOAC | 0.98 g |
| DEPC H$_2$O | |
| Total | 20 ml |

Array Wash and Staining

Stringent Wash Buffer**
Non-Stringent Wash Buffer***
SAPE Stain****
Antibody Stain*****

Wash on fluidics station using the appropriate antibody amplification protocol
**Stringent Buffer: 12X MES 83.3 ml, 5 M NaCl 5.2 ml, 10% Tween 1.0 ml, H$_2$O 910 ml, Filter Sterilize
***Non-Stringent Buffer: 20X SSPE 300 ml, 10% Tween 1.0 ml, H$_2$O 698 ml, Filter Sterilize, Antifoam 1.0.
****SAPE stain: 2X Stain Buffer 600 µl, BSA 48 µl, SAPE 12 µl, H$_2$O 540 µl.
*****Antibody Stain: 2X Stain Buffer 300 µl, H$_2$O 266.4 µl, BSA 24 µl, Goat IgG 6 µl, Biotinylated Ab 3.6 µl Image Analysis and Data Mining
1. Two text files are included in the analysis:
   a. One with Absolute analysis: giving the status of each gene, either absent or present in the samples
   b. The other with Comparison analysis: comparing gene expression levels between two samples Example 5

Rice Genes Induced by *Magnaporthe grisea* Infection

*Magnaporthe grisea* is a fungus that causes the disease rice blast. A rice gene chip is used to identify pathogen-induced genes that showed induction of at least 2.5-fold in pathogen-infected samples relative to control samples. Rice is infected with a virulent *Magnaporthe grisea* strain (CP283) ("vir"), an avirulent strain (IE-1k) ("avr"), or mock-infected by spraying with Tween 20. Samples are collected 12, 24, 36, 48, and 72 hours later. For each time point, and for both vir and avr strains, an infected/mock ratio is calculated and all values below 5 are converted to 5. Some genes (called "M") had expression values as high as 500, while other genes (called "P") had expression values as low as 10. P genes are incorporated into the selection criteria.

To select *Magnaporthe grisea*-induced genes, four sets of conditions are used:
(Vir12 call=P AND Vir12 exp>75 AND Vir12/mock12>2.5) OR
(Vir24 call=P AND Vir24 exp>75 AND Vir24/mock24>2.5) OR
(Vir36 call=P AND Vir36 exp>75 AND Vir36/mock36>2.5) OR
(Vir48call=P AND Vir48 exp>75 AND Vir48/mock48>2.5) OR
(Vir72call=P AND Vir72 exp>75 AND Vir72/mock72>2.5).

Using those conditions for vir, 362 probesets are identified. Using avr data, 750 probesets are identified.

A third set of genes is identified in which the genes showed inducible expression of at least two adjacent time points or are strongly induced only at 72 hours. The conditions for this analysis are:

(Vir12 call=P AND Vir12 exp>75 AND Vir12/mock12>2.5 AND Vir24 call=P AND Vir24exp>50 AND Vir24/mock24>2) OR (Vir12 call=P AND Vir12 exp>50 AND Vir12/mock12>2 AND Vir24 call=P AND Vir24exp>75 AND Vir24/mock24>2.5) OR (Vir24 call=P AND Vir24 exp>75 AND Vir24/mock24>2.5 AND Vir36 call=P AND Vir36exp>50 AND Vir36/mock36>2) OR (Vir24 call=P AND Vir24 exp>50 AND Vir24/mock24>2 AND Vir36 call=P AND Vir36exp>75 AND Vir36/mock36>2.5) OR (Vir36 call=P AND Vir36exp>75 AND Vir36/mock36>2.5 AND Vir48 call=P AND Vir48exp>50 AND Vir48/mock48>2) OR (Vir36 call=P AND Vir36exp>50 AND Vir36/mock36>2 AND Vir48 call=P AND Vir48exp>75 AND Vir48/mock48>2.5) OR (Vir48 call=P AND Vir48exp>75 AND Vir48/mock48>2.5 AND Vir72 call=P AND Vir72exp>50 AND Vir72/mock72>2) OR (Vir48 call=P AND Vir48exp>50 AND Vir48/mock48>2 AND Vir72 call=P AND Vir72exp>75 AND Vir72/mock72>2.5) OR (Vir 72 call=P AND Vir72exp>125 AND Vir72/mock72>4) OR (Vir 72 call=P AND Vir72exp>150 AND Vir72/mock72>3).

These conditions identified 193 probesets.

A similar analysis using avr data, which included transient gene expression changes at early time points, i.e., genes with strong induction at 12 hours only, is conducted. The conditions are:

(Avr12 call=P AND Avr12 exp>125 AND Avr12/mock12>4) OR (Avr12 call=P AND Avr12 exp>150 AND Avr12/mock12>3) OR (Avr12 call=P AND Avr12 exp>75 AND Avr12/mock12>2.5 AND Avr24 call=P AND Avr24exp>50 AND Avr24/mock24>2) OR (Avr12 call=P AND Avr12 exp>50 AND Avr12/mock12>2 AND Avr24 call=P AND Avr24exp>75 AND Avr24/mock24>2.5) OR (Avr24 call=P AND Avr24 exp>75 AND Avr24/mock24>2.5 AND Avr36 call=P AND Avr36exp>50 AND Avr36/mock36>2) OR (Avr24 call=P AND Avr24 exp>50 AND Avr24/mock24>2 AND Avr36 call=P AND Avr36exp>75 AND Avr36/mock36>2.5) OR (Avr36 call=P AND Avr36exp>75 AND Avr36/mock36>2.5 AND Avr48 call=P AND Avr48exp>50 AND Avr48/mock48>2) OR (Avr36 call=P AND Avr36exp>50 AND Avr36/mock36>2 AND Avr48 call=P AND Avr48exp>75 AND Avr48/mock48>2.5) OR (Avr48 call=P AND Avr48exp>75 AND Avr48/mock48>2.5 AND Avr72 call=P AND Avr72exp>50 AND Avr72/mock72>2) OR (Avr48 call=P AND Avr48exp>50 AND Avr48/mock48>2 AND Avr72 call=P AND Avr72exp>75 AND Avr72/mock72>2.5).

This analysis yielded 178 probesets.

The sets of genes induced by the vir and avr strains are quite similar

Vir (362 probesets) AND Avr (750 probesets): 278 probesets
Vir (362 probesets) AND Avr (178 probesets): 124 probesets
Vir (193 probesets) AND Avr (750 probesets): 186 probesets
Vir (193 probesets) AND Avr (178 probesets): 105 probesets For clustering and comparison to *Arabidopsis* data, genes that are in the set for vir one AND Avr one OR Vir two OR Avr two are combined using the Access union function in SQL, resulting in 339 probesets (Table 3). After subtracting the duplicates from the total, the 339 probesets are found to correspond to 297 different genes.

Example 6

Identification of Common Pathogen-Induced Genes in Rice and *Arabidopsis*

If the defense responses in *Arabidopsis* and rice are similar, data related to genes associated with disease resistance in *Arabidopsis* may identify similar disease resistance genes in rice and other cereals. Moreover, if an *Arabidopsis* gene and a rice gene have a similar sequence, and they are both induced in response to pathogen attack, these genes are likely to be important in disease resistance relative to genes that are only observed to be induced in a single plant-pathogen interaction. To identify such common genes, *Arabidopsis* genes that are induced by the bacterial pathogen *Pseudomonas syringae* or the fungal pathogen *Botrytis cinerea* are compared to rice genes induced by *Magnaporthe grisea*. For rice the 339 probesets induced by *Magnaporthe* infection are used (Example 5). For *Arabidopsis*, 745 probesets induced by *Pseudomonas syringae* 4326 infection (where the infected/mock>2.5 and 4326 infected>50 in at least 2 of 3 sets of wild-type samples) and 690 probesets induced by *Botrytis cinerea* infection of *Arabidopsis* at more than one time point (Bc 12 call=P AND Bc 12 exp>50 AND Bc12/mock12>2.5 AND Bc 36 call=P AND Bc 36 exp>40 AND Bc36/mock36>2) OR (Bc 12 call=P AND Bc 12 exp>40 AND Bc12/mock12>2 AND Bc 36 call=P AND Bc 36 exp>50 AND Bc36/mock36>2.5) OR (Bc 36 call=P AND Bc 36 exp>50 AND Bc36/mock36>2.5 AND Bc 60 call=P AND Bc 60 exp>40 AND Bc60/mock60>2) OR (Bc 36 call=P AND Bc 36 exp>40 AND Bc36/mock36>2 AND Bc 60 call=P AND Bc 60 exp>50 AND Bc60/mock60>2.5) OR (Bc 60 call=P AND Bc 60 exp>50 AND Bc60/mock60>2.5 AND Bc 84 call=P AND Bc 84 exp>40 AND Bc84/mock84>2) OR (Bc 60 call=P AND Bc 60 exp>40 AND Bc60/mock60>2 AND Bc 84 call=P AND Bc 84 exp>50 AND Bc84/mock84>2.5) are used. For data from wild-type plants, expression values lower than 5 are set to 5. Genes induced by infection in each organism are used in a BLAST analysis against each other in 6-frame translation. Pathogen-induced genes in one organism that have a structurally related pathogen-induced gene in the other organism are then identified.

There are 457 probesets in common between *Pseudomonas syringae*-infected *Arabidopsis* samples and *Botrytis cinerea*-infected *Arabidopsis* samples. More than half of the probesets in the *Pseudomonas syringae*-infected probesets and the *Botrytis cinerea*-infected probesets are in both sets. The number of different probesets represented is 978.

For BLAST analysis, a FASTA sequence corresponding to each full-length rice gene is identified. Each rice gene is used as a query for two tBLASTx searches, one against the *Pseudomonas*-induced genes and one against the *Botrytis*-induced genes. A few probesets did not have corresponding sequences.

Table 3 shows the results of that analysis (for *Pseudomonas*: At probeset (Ps): Closest BLAST match; TIGR ID (Ps): TIGR number for this gene; At annotation (Ps): Annotation for this gene; and *Botrytis* (At probeset (Bc); Closest BLAST match; TIGR ID (Bc): TIGR number for this gene; At annotation (Bc): Annotation for this gene). Rice genes of interest in Table 3 include those which have a corresponding pathogen-induced gene in *Arabidopsis*, and more preferably, where the corresponding gene is the gene in the *Arabidopsis* genome which is the closest match.

A total of 88 close matches (includes some probeset duplicates) between pathogen-induced genes in rice and *Arabidopsis* is observed. There are 6 genes of unknown function that are induced in both organisms. Thus, pathogen-induced genes in rice and in *Arabidopsis* are very similar.

Using full-length gene predictions, there are 114 matches of rice genes to *Arabidopsis* pathogen-induced genes out of 297 rice genes. This is nearly 50%. There are 42 other probesets and among these 42, 3 had matches to *Arabidopsis* pathogen-induced genes.

To test the disease resistant phenotype of the identified rice genes, the corresponding cDNA is inserted into an expression vector, e.g., downstream of a maize ubiquitin promoter. The vector is introduced into cells of a cereal plant, for instance, wheat, by biolistic transformation. The resulting transformants (or progeny thereof) are contacted with a pathogen such as *Magnaporthe grisea* and the disease resistant phenotype of the infected transformants observed.

Example 7

Vectors for Plant Transformation

Overexpression Vectors

Vectors used for expression of full-length genes of interest in plants (overexpression) are designed to overexpress the protein of interest and are of two general types, biolistic and binary, depending on the plant transformation method to be used.

For biolistic transformation, biolistic vectors include i) a backbone with a bacterial selectable marker (typically, an antibiotic resistance gene) and origin of replication functional in *Escherichia coli* (*E. coli*; e.g., ColE1), ii) a plant-specific portion including a gene expression cassette comprising a promoter (e.g., ZmUBIint MOD), the gene of interest (typically, a full-length cDNA) and a transcriptional terminator (e.g., *Agrobacterium tumefaciens* nos terminator), and a plant selectable marker cassette comprising a promoter (e.g., rice Act1D-BV MOD), a selectable marker gene (e.g., phosphomannose isomerase, PMI) and a transcriptional terminator (e.g., CaMV terminator).

Vectors for transformation by *Agrobacterium tumefaciens* (*A. tumefaciens*; binary vectors) include i) a backbone with a bacterial selectable marker functional in both *E. coli* and *A. tumefaciens* (e.g., spectinomycin resistance mediated by the aadA gene) and two origins of replication, functional in each of aforementioned bacterial hosts, plus the *A. tumefaciens* virG gene, and ii) a plant-specific portion as described above for biolistic vectors except that this portion is flanked by *A. tumefaciens* right and left border sequences which mediate transfer of the DNA flanked by these two sequences to the plant.

Knock Out Vectors

Vectors designed for reducing or abolishing expression of a single gene or of a family of related genes (knockout vectors) are also of two general types corresponding to the methodology used to downregulate gene expression: antisense or double-stranded RNA interference (dsRNAi).

Antisense Vectors

For antisense vectors, a full-length or partial gene fragment (typically, a portion of the cDNA) can be used in the same vectors described for full-length expression, as part of the gene expression cassette. For antisense-mediated downregulation of gene expression, the coding region of the gene or gene fragment is in the opposite orientation relative to the promoter, thus, mRNA corresponds to the non-coding (antisense) strand in planta.

dsRNAi Vectors

For dsRNAi vectors, a partial gene fragment (typically, 300 to 500 basepairs long) is used in the gene expression cassette, and is expressed in both the sense and antisense orientations, separated by a spacer region (typically, a plant intron, e.g., the OsSH1 intron 1, or a selectable marker, e.g., one conferring kanamycin resistance). Vectors of this type are designed to form a double-stranded mRNA stem, resulting from the base-pairing of the two complementary gene fragments in planta.

Biolistic or binary vectors designed for overexpression or knockout can vary in a number of different ways, including the selectable markers used in plant and bacteria, the transcriptional terminators used in the gene expression and plant selectable marker cassettes, the methodologies used for cloning in gene or gene fragments of interest (typically, conventional restriction enzyme-mediated or Gateway™ recombinase-based cloning) and the nature of the gene expression cassette promoter driving expression of the gene or gene fragment of interest. For example, the promoter may drive expression in most tissues of the plants (constitutive, e.g., ZmUBIint MOD), in specific plant tissues (e.g., maize ADP-gpp for endosperm-specific expression), or in an inducible fashion (e.g., GAL4bsBz1 for estradiol-inducible expression in lines constitutively expressing the cognate transcriptional activator for this promoter).

Example 8

Insertion of a "$DIS^R$ Candidate Gene" into a Plant Expression Vector

For example, a $DIS^R$ cDNA or a fragment thereof is subcloned using conventional restriction enzyme-based cloning into a vector, downstream of the maize ubiquitin promoter and intron, and upstream of the *Agrobacterium tumefaciens* nos 3' end transcriptional terminator. The resultant gene expression cassette is further subcloned, using conventional restriction enzyme-based cloning, into the pNOV2117 binary vector (Negrotto et al (2000) Plant Cell Reports 19, 798-803; plasmid pNOV117 disclosed in this article corresponds to pNOV2117 described herein; the nucleotide sequence of pNOV2117 is provided in SEQ ID NO: 44 of WO 01/73087), generating pNOVDIS$^R$.

The pNOVDIS$^R$ binary vector is designed for transformation and overexpression of DIS$^R$ in monocots. The vector including a binary backbone containing the sequences necessary for selection and growth in *Escherichia coli* DH-5α (Invitrogen) and *Agrobacterium tumefaciens* LBA4404 (pAL4404; pSB1), including the bacterial spectinomycin antibiotic resistance aadA gene from *E. coli* transposon Tn7, origins of replication for *E. coli* (ColE1) and *A. tumefaciens* (VS1), and the *A. tumefaciens* virG gene. In addition to the binary backbone, which is identical to that of pNOV2114 described herein previously (see Example 3 above), pNOV2117 contains the T-DNA portion flanked by the right and left border sequences, and including the Positech™ (Syngenta) plant selectable marker and the CBP80 gene expression cassette. The Positech™ plant selectable marker confers resistance to mannose via a cassette including the maize ubiquitin promoter driving expression of the PMI (phosphomannose isomerase) gene followed by the CMV transcriptional terminator.

Plasmid pNOV2117 is introduced into *Agrobacterium tumefaciens* LBA4404 (pAL4404; pSB1) by electroporation. Plasmid pAL4404 is a disarmed helper plasmid (Ooms et al (1982) Plasmid 7, 15-29). Plasmid pSB1 is a plasmid with a wide host range that contains a region of homology to pNOV2117 and a 15.2 kb KpnI fragment from the virulence region of pTiBo542 (Ishida et al (1996) Nat Biotechnol 14, 745-750). Introduction of plasmid pNOV2117 into *Agrobacterium* strain LBA4404 results in a co-integration of pNOV2117 and pSB1.

Alternatively, plasmid pCIB7613, which contains the hygromycin phosphotransferase (hpt) gene (Gritz and Davies, Gene 25, 179-188, 1983) as a selectable marker, may be employed for transformation.

Plasmid pCIB7613 (see WO 98/06860, incorporated herein by reference in its entirety) is selected for rice transformation. In pCIB7613, the transcription of the nucleic acid sequence coding hygromycin-phosphotransferase (HYG gene) is driven by the corn ubiquitin promoter (ZmUbi) and enhanced by corn ubiquitin intron 1. The 3'polyadenylation signal is provided by NOS 3' nontranslated region.

Other useful plasmids include pNADII002 (GAL4-ER-VP16) which contains the yeast GAL4 DNA Binding domain (Keegan et al., *Science,* 231:699 (1986)), the mammalian estrogen receptor ligand binding domain (Greene et al., *Science,* 231:1150 (1986)) and the transcriptional activation domain of the HSV VP16 protein (Triezenberg et al., 1988). Both hpt and GAL4-ER-VP16 are constitutively expressed using the maize Ubiquitin promoter, and pSGCDL1 (GAL4BS Bz1 Luciferase), which carries the firefly luciferase reporter gene under control of a minimal maize Bronze1 (Bz1) promoter with 10 upstream synthetic GAL4 binding sites. All constructs use termination signals from the nopaline synthase gene.

Example 9

Plant Transformation 9.1 Rice Transformation pNOVDIS$^R$ is transformed into a rice cultivar (Kaybonnet) using *Agrobacterium*-mediated transformation, and mannose-resistant calli are selected and regenerated. *Agrobacterium* is grown on YPC solid plates for 2-3 days prior to experiment initiation. Agrobacterial colonies are suspended in liquid MS media to an OD of 0.2 at λ600 nm. Acetosyringone is added to the agrobacterial suspension to a concentration of 200 μM and the bacteria are induced for 30 minutes.

Three-week-old calli which are induced from the scutellum of mature seeds in the N6 medium (Chu et al., 1975) are incubated in the *Agrobacterium* solution in a 100×25 petri plate for 30 minutes with occasional shaking. The solution is then removed with a pipette and the callus transferred to a MSAs medium which is overlayed with sterile filter paper. Co-cultivation is continued for 2 days in the dark at 22° C. Calli are then placed on MS-Timetin plates for 1 week, after which they are transferred to PAA+ mannose selection media for 3 weeks. Growing calli are picked and transferred to PAA+ mannose media and cultivated for 2 weeks in light.

Colonies are transferred to MS20SorbKinTim regeneration media in plates for 2 weeks in light. Small plantlets are transferred to MS20SorbKinTim regeneration media in GA7 containers. When they reach the lid, they are transferred to soil in the greenhouse.

Alternatively, plasmid pCIB7613, which contains the hygromycin phosphotransferase (hpt) gene as a selectable marker, may be employed for transformation. Other useful plasmids include pNADII002 (GAL4-ER-VP16) which contains the yeast GAL4 DNA Binding domain (Keegan et al., 1986), the mammalian estrogen receptor ligand binding domain (ER; Greene et al., 1986)) and the transcriptional activation domain of the HSV VP16 protein (Triezenberg et al., 1988). Both hpt and GAL4-ER-VP16 are constitutively expressed using the maize Ubiquitin promoter, and pSGCDL1 (GAL4BS Bz1 Luciferase), which carries the firefly luciferase reporter gene under control of a minimal maize Bronze1 (Bz1) promoter with 10 upstream synthetic GALA binding sites. All constructs use termination signals from the nopaline synthase gene.

*Oryza sativa* L. Japonica CV. Taipei 309 may be are used for the production of transgenic rice plants. Callus induction, cell suspension, initiation, and maintenance follow protocols previously described by Zhang (1995). Gene transfer is achieved using the Biolistic PDS-1000 system (Bio-Rad. Hercules, Calif.). pCIB7613 is co-transferred with other plasmids in a 1:5 molar ratio. DNA coating, high-velocity microprojectile delivery of DNA, selection, and regeneration of transgenic plants are achieved according to Zhang et al (1998) and Chen et al (1998a).

Estradiol (Sigma) is resuspended in 95% ethanol and diluted in water containing 0.01% Triton X-100 immediately before use. The same volume of 95% ethanol is added to the negative control solution without estradiol. Approximately ten-milligram samples of fresh plant tissue are excised and submerged in estradiol solution, and cultured at 25° C. without light. In whole-plantlet treatments, either intact plantlets are submerged in 1 μM estradiol solution and cultured at 25° C. in dark for 24 hours, or plantlet roots are submerged in ½ MS salts (Murashige and Skoog, 1962) liquid medium containing estradiol followed by incubation at 25° C. with 16 hour light cycles.

Expression of the DIS$^R$ in transgenic $T_0$ plants is analyzed. Additional rice cultivars, including but not limited to, Nipponbare, Taipei 309 and Fuzisaka 2 are also transformed and assayed for expression of the DIS$^R$ product and enhanced protein expression.

9.2 Maize Transformation

Alternatively, pNOVDIS$^R$ is transformed into immature maize embryos. Transformation of immature maize embryos is performed essentially as described in Negrotto et al., (2000) Plant Cell Reports 19: 798-803. For this example, all media constituents are as described in Negrotto et al., supra. However, various media constituents described in the literature may be substituted.

1. Transformation Plasmids and Selectable Marker

The genes used for transformation are cloned into a vector suitable for maize transformation as described in Examples 7 and 8. Vectors used contain the phosphomannose isomerase (PMI) gene (Negrotto et al. (2000) Plant Cell Reports 19: 798-803).

2. Preparation of *Agrobacterium tumefaciens*

*Agrobacterium* strain LBA4404 (pSB1) containing the plant transformation plasmid is grown on YEP (yeast extract (5 g/L), peptone (10 g/L), NaCl (5 g/L), 15 g/l agar, pH 6.8) solid medium for 2 to 4 days at 28° C. Approximately 0.8×10$^9$ *Agrobacteria* are suspended in LS-inf media supplemented with 100 µM acetosyringone (As) (Negrotto et al., (2000) Plant Cell Rep 19: 798-803). Bacteria are pre-induced in this medium for 30-60 minutes.

3. Inoculation

Immature embryos from A188 or other suitable maize genotypes are excised from 8-12 day old ears into liquid LS-inf+100 µM As. Embryos are rinsed once with fresh infection medium. *Agrobacterium* solution is then added and embryos are vortexed for 30 seconds and allowed to settle with the bacteria for 5 minutes. The embryos are then transferred scutellum side up to LSAs medium and cultured in the dark for two to three days. Subsequently, between 20 and 25 embryos per petri plate are transferred to LSDc medium supplemented with cefotaxime (250 mg/l) and silver nitrate (1.6 mg/l) and cultured in the dark for 28° C. for 10 days.

4. Selection of Transformed Cells and Regeneration of Transformed Plants

Immature embryos producing embryogenic callus are transferred to LSD1M0.5S medium. The cultures are selected on this medium for 6 weeks with a subculture step at 3 weeks. Surviving calli are transferred either to LSD1M0.5S medium to be bulked-up or to Reg1 medium. Following culturing in the light (16 hour light/8 hour dark regiment), green tissues are then transferred to Reg2 medium without growth regulators and incubated for 1-2 weeks. Plantlets are transferred to Magenta GA-7 boxes (Magenta Corp, Chicago Ill.) containing Reg3 medium and grown in the light. Plants that are PCR positive for the DIS$^R$ gene cassette are transferred to soil and grown in the greenhouse.

Example 10

Use of a Rice Oxalate Oxidase Gene as a DIS$^R$ Candidate Gene in Plant Transformation 10.1 Use of Oxalate Oxidase Expression Plants ToResist Pathogens Multiple plant pathogens synthesise oxalate. For one of these pathogens (Sclerotinia sclerotiorum) it has been shown that oxalate acts as a virulence factor. When the oxalate is degraded in transgenic soybean, sunflower, oil seed rape, tomato, *Arabidopsis* or tobacco through the activity of a oxalate oxidase, the plants become resistant to this pathogen. Thus, plants can be generated that contain a Osox4 transgene and become resistant to Sclerotinia, and other pathogens that use oxalate as a virulence factor upon expression of the oxalate oxidase in the plant cells.

Since Sclerotinia is a pathogen of many plant species (including many oilseeds, and vegetables), this technology has wide application.

To Generate Low Oxalate Plants

Some plants contain large amounts of oxalate in parts that are consumed by humans and animals (e.g. soy protein, spinach, rhubarb). By targeting the oxalate oxidase to those compartments where the oxalate is stored or generated, the oxalate can be degraded, leading to plants with low oxalate levels. Alternatively, the enzyme can be expressed in selected tissues or organelles in the plant, where the oxalate is not present. Upon processing of the plant material, the plant tissues are crushed and mixed, and the enzyme can be allowed to degrade the oxalate in the mixture during a processing step. The latter may require engineering of the oxalate oxidase to enhance its activity in the mixed food, or to include a processing step that allows the oxalate oxidase to be active and degrade the oxalate in the food.

To Degrade Oxalate in Food

Oxalate oxidase expressing plants can also be used to degrade oxalate present in other foods. When food products are processed into their final form, oxalate oxidase containing material can be incorporated in the final product, and allowed to degrade the oxalate in the food. Alternatively, the oxalate oxidase containing food can be part of the diet, allowing the oxalate oxidase to degrade dietary oxalate in the intestines of the organism. The latter may require engineering of the oxalate oxidase to enhance its activity in the environment of the stomach or intestines.

10.2 Other Uses of Oxalate Oxidase

Precipitates of calcium oxalate form easily. In kidneys, calcium oxalate is frequently found as a component of kidney stones. In processes or solutions where oxalate and calcium are present, calcium oxalate crystals can form, and cause problems. These include calcium oxalate crystals that form during fermentation, leading to poor filtration in subsequent processing steps. In supersaturated urine, calcium oxalate crystals can form on urinary stints, which become initiation points for bacterial attachment and infection. Likewise, kidney stones containing calcium oxalate are a significant health issue. In all of these, appropriate uses of oxalate oxidases can prevent calcium oxalate crystals from forming.

10.3 Identification of OxoxCandidate Genes

It is a prerequisite for the above suggested uses of oxalate oxidase in plants that suitable candidate genes can be identified and isolated and successfully introduced and expressed in plants.

10.3.1 Identification of Oxox Homologs in the Rice Genome Database

Known cereal germin isoforms of oxalate oxidases are used to query the rice database (using BLASTN, BLASTP algorithms). A sequence with high homology is identified and named Osox4. A rice EST database is similarly queried, and sequences with high similarity are identified amongst the ESTs.

10.3.2 Cloning of the Rice Osox4 Gene.

The sequence corresponding to Osox4 is PCR amplified, using gene specific primers designed to the presumed 5' and 3' untranslated regions of the sequences. The PCR products are cloned, and sequenced. The ORF is identified and listed as SEQ ID NO: 1387.

10.3.3 Expression of the Putative Oxalate Oxidase Homologs.

The Osox4 sequence is PCR amplified with primers corresponding to the start site ("START" primers) and the end of the ORF ("END" primers). The START primers all contain the ATG start codon, and, in addition, further 5'sequences that would facilitate cloning and expression of the gene product. Thus, all the START primers include the following sequence in a 5' to 3' orientation (SEQ ID NO: 1393)
5'-GGATCCGCCGCCCC<u>ATG</u>-3-, wherein the start site is underlined. This sequence includes a BamHI site to facilitate cloning, and a Kozak sequence to enhance expression in cells. The END primers also contain a BamHI site 3' to the stop codon, again to facilitate cloning.

In a next step, the PCR products are cloned, and individual clones are sequenced. Following BamHI digestion, inserts are prepared from clones which are expected to contain the desired sequences. These are cloned into a vector between a strong constitutive promoter such as, for example, the Cestrum virus CMP) promoter and a terminator functional in plants such as the nos terminator. A plasmid, which places the inserts between the Cestrum virus CMP) promoter and the nos terminator the nos terminator is, for example, pNOV6415.

Clones, which are demonstrated to contain the insert in the correct orientation (i.e., one that would allow expression) are grown and subsequently digested with AscI-AlnwI. The CMP-ORF-nos cassettes are purified and cloned into AscI-AlwnI digested *Agrobacterium* vector such as, for example pNOV1900, or any other suitable *Agrobacterium* vector mentioned hereinbefore. AscI-AlwnI digestion of pNOV1900 places the CMP-Osox-nos gene cassette into the T-DNA region of the vector. The resulting plasmid, which contains Osox4, is named pTC4.

This plasmid is transformed into *Agrobacterium* strain EHA101, as are several control plasmids. These include a vector which contains the wheat oxalate oxidase gene, linked to a promoter such as, for example, pNOV6412, and another one which contains a GUS gene, linked to a promoter such as pNOV2105.

The *Agrobacterium* strains are grown in IMT medium. Following adjustment to OD(660) of approximately 0.05, tobacco leaf segments are infiltrated with these strains, and with IMT medium alone. The plants are grown for 3 days, after which infiltrated leaf pieces are isolated with a #5 cork bore. These are stained for oxalate oxidase activity, using the chloronaphthol/HRP procedure. In this procedure, oxalate is degraded by oxalate oxidase, leading to the generation of carbon dioxide and hydrogen peroxide. The latter is used by horse radish peroxidase to oxidize chloronaphthol, and the resulting product forms a purple precipitate. The results show that IMT infiltrated leaf segments do not develop the purple precipitate, whereas the leaf segments infiltrated with *Agrobacterium* strains containing the rice Osox gene-constructs do develop purple spots. An intense color is seen in leaf segments infiltrated with the pTC4 containing *Agrobacterium* strains. Thus, these results show that the rice Osox 4 gene exhibits oxalate oxidase activity.

The pNOV2105 infiltrated leaf segments are analyzed for GUS expression. These control leaf segments indeed stained blue, indicative of GUS enzyme expression in these leaf tissues.

Example 11

Chromosomal Markers to Identify the Location of a Nucleic Acid Sequence

The sequences of the present invention can also be used for SSR mapping. SSR mapping in rice has been described by Miyao et al. (*DNA Res* 3:233 (1996)) and Yang et al. (*Mol Gen Genet* 245:187 (1994)), and in maize by Ahn et al. (*Mol Gen Genet* 241:483 (1993)). SSR mapping can be achieved using various methods. In one instance, polymorphisms are identified when sequence specific probes flanking an SSR contained within a sequence according to the invention are made and used in polymerase chain reaction (PCR) assays with template DNA from two or more individuals or, in plants, near isogenic lines. A change in the number of tandem repeats between the SSR-flanking sequence produces differently sized fragments (U.S. Pat. No. 5,766,847). Alternatively, polymorphisms can be identified by using the PCR fragment produced from the SSR-flanking sequence specific primer reaction as a probe against Southern blots representing different individuals (Refseth et al., *Electrophoresis* 18:1519 (1997)). Rice SSRs can be used to map a molecular marker closely linked to functional gene, as described by Akagi et al. (*Genome* 39:205 (1996)).

The sequences of the present invention can be used to identify and develop a variety of microsatellite markers, including the SSRs described above, as genetic markers for comparative analysis and mapping of genomes.

Many of the polynucleotides listed in Tables 1, 2, and 3 and provided in the Sequence Listing contain at least 3 consecutive di-, tri- or tetranucleotide repeat units in their coding region that can potentially be developed into SSR markers. Tri- and tetra-nucleotide motifs that can be commonly found in the coding regions of said polynucleotides (for example: CGG; GCC, CGC, GGC, etc) are illustrated in table 9 with the start and end points being identified. Once such a repeat unit has been found, primers can be designed which are complementary to the region flanking the repeat unit and used in any of the methods described below.

Sequences of the present invention can also be used in a variation of the SSR technique known as inter-SSR (ISSR), which uses microsatellite oligonucleotides as primers to amplify genomic segments different from the repeat region itself (Zietkiewicz et al., *Genomics*, 20:176 (1994)). ISSR employs oligonucleotides based on a simple sequence repeat anchored or not at their 5'- or 3'-end by two to four arbitrarily chosen nucleotides, which triggers site-specific annealing and initiates PCR amplification of genomic segments which are flanked by inversely orientated and closely spaced repeat sequences. In one embodiment of the present invention, microsatellite markers as disclosed herein, or substantially similar sequences or allelic variants thereof, may be used to detect the appearance or disappearance of markers indicating genomic instability as described by Leroy et al. *Electron. J. Biotechnol.*, 3(2):140-149 (2000)), where alteration of a fingerprinting pattern indicated loss of a marker corresponding to a part of a gene involved in the regulation of cell proliferation. Microsatellite markers are useful for detecting genomic alterations such as the change observed by Leroy et al. (Electron. J Biotechnol, 3(2), supra (2000)) which appeared to be the consequence of microsatellite instability at the primer binding site or modification of the region between the microsatellites, and illustrated somaclonal variation leading to genomic instability. Consequently, sequences of the present invention are useful for detecting genomic alterations involved in somaclonal variation, which is an important source of new phenotypes.

In addition, because the genomes of closely related species are largely syntenic (that is, they display the same ordering of genes within the genome), these maps can be used to isolate novel alleles from wild relatives of crop species by positional cloning strategies. This shared synteny is very powerful for using genetic maps from one species to map genes in another. For example, a gene mapped in rice provides information for the gene location in maize and wheat.

Example 12

Quantitative Trait Linked Breeding

Various types of maps can be used with the sequences of the invention to identify Quantitative Trait Loci (QTLs) for a variety of uses, including marker-assisted breeding. Many important crop traits are quantitative traits and result from the combined interactions of several genes. These genes reside at different loci in the genome, often on different chromosomes, and generally exhibit multiple alleles at each locus. Developing markers, tools, and methods to identify and isolate the QTLs involved in a trait, enables marker-assisted breeding to enhance desirable traits or suppress undesirable traits. The sequences disclosed herein can be used as markers for QTLs to assist marker-assisted breeding. The sequences of the invention can be used to identify QTLs and isolate alleles as described by Li et al. in a study of QTLs involved in resistance to a pathogen of rice. (Li et al., *Mol Gen Genet* 261:58 (1999)). In addition to isolating QTL alleles in rice, other cereals, and other monocot and dicot crop species, the sequences of the invention can also be used to isolate alleles from the corresponding QTL(s) of wild relatives. Transgenic plants having various combinations of QTL alleles can then be created and the effects of the combinations measured. Once an ideal allele combination has been identified, crop improvement can be accomplished either through biotechnological means or by directed conventional breeding programs. (Flowers et al., *J Exp Bot* 51:99 (2000); Tanksley and McCouch, *Science* 277:1063 (1997)).

Example 13

Marker-Assisted Breeding

Markers or genes associated with specific desirable or undesirable traits are known and used in marker assisted breeding programs. It is particularly beneficial to be able to screen large numbers of markers and large numbers of candidate parental plants or progeny plants. The methods of the invention allow high volume, multiplex screening for numerous markers from numerous individuals simultaneously.

Markers or genes associated with specific desirable or undesirable traits are known and used in marker assisted breeding programs. It is particularly beneficial to be able to screen large numbers of markers and large numbers of candidate parental plants or progeny plants. The methods of the invention allow high volume, multiplex screening for numerous markers from numerous individuals simultaneously.

A multiplex assay is designed providing SSRs specific to each of the markers of interest. The SSRs are linked to different classes of beads. All of the relevant markers may be expressed genes, so RNA or cDNA techniques are appropriate. RNA is extracted from root tissue of 1000 different individual plants and hybridized in parallel reactions with the different classes of beads. Each class of beads is analyzed for each sample using a microfluidics analyzer. For the classes of beads corresponding to qualitative traits, qualitative measures of presence or absence of the target gene are recorded. For the classes of beads corresponding to quantitative traits, quantitative measures of gene activity are recorded. Individuals showing activity of all of the qualitative genes and highest expression levels of the quantitative traits are selected for further breeding steps. In procedures wherein no individuals have desirable results for all the measured genes, individuals having the most desirable, and fewest undesirable, results are selected for further breeding steps. In either case, progeny are screened to further select for homozygotes with high quantitative levels of expression of the quantitative traits.

Example 14

Method of Modifying the Gene Frequency

The invention further provides a method of modifying the frequency of a gene in a plant population, including the steps of: identifying an SSR within a coding region of a gene; screening a plurality of plants using the SSR as a marker to determine the presence or absence of the gene in an individual plant; selecting at least one individual plant for breeding based on the presence or absence of the gene; and breeding at least one plant thus selected to produce a population of plants having a modified frequency of the gene. The identification of the SSR within the coding region of a gene can be accomplished based on sequence similarity between the nucleic acid molecules of the invention and the region within the gene of interest flanking the SSR.

Supporting Tables

TABLE 3

Using reverse genetics in *Arabidopsis* (using the GARLIC collection as described in Example 2), a number of *Arabidopsis* genes are identified that are required for disease resistance. Genes from mutant plants which, upon infection with the bacterial pathogen *Pseudomonas syringae*, show more severe disease symptoms as compared to the wild-type plants are searched for similar rice genes. The rice orthologs are the identified in Column A.
Column B refers to rice genes found to be induced by infection of rice plants with the fungal pathogen *Magnaporthe grisea*. Plant samples are profiled on the rice chip and the data analyzed according to Example 4 and 6 . . .
Column C and D identifies public QTLs to which the genes in the SEQ ID column are mapped.

| SEQ ID | A | B | C | D |
|---|---|---|---|---|
| 1 | — | X | — | |
| | | | | ZM-APIT-2-1, |
| | | | | ZM-CRR-2-11, |
| | | | | ZM-ECB-2-2, |
| | | | | ZM-GLS-2-1, |
| | | | | ZM-PCSI-2-4 |
| 5 | — | X | — | — |
| 7 | — | X | — | — |
| 9 | — | X | — | — |
| 11 | — | X | — | — |
| 19 | — | X | — | — |
| 21 | — | X | — | — |
| 23 | — | X | — | — |
| 25 | — | X | — | — |
| 27 | X | — | — | — |
| 29 | — | X | — | — |
| 33 | — | X | — | — |
| 35 | — | X | — | — |
| 37 | X | — | — | — |
| 39 | — | X | — | — |
| 41 | — | X | — | — |
| 45 | — | X | — | — |
| 51 | — | X | — | — |
| 53 | — | X | — | — |
| 55 | — | X | — | — |
| 57 | — | X | — | — |
| 61 | — | X | — | — |
| 63 | — | X | — | — |
| 67 | — | X | — | — |
| 69 | — | X | — | — |
| 71 | — | X | — | — |
| 79 | — | X | — | — |
| 81 | — | X | — | — |
| 87 | — | X | — | — |
| 89 | — | X | — | — |
| 91 | X | — | — | , |
| | | | | ZM-APIT-2-1, |
| | | | | ZM-CRR-2-11, |
| | | | | ZM-CRR-7-6, |
| | | | | ZM-CSVEG-7-1, |
| | | | | ZM-ECB-2-2, |
| | | | | ZM-GLS-2-1, |
| | | | | ZM-GLS-7-2, |
| | | | | ZM-GLS-7-2, |
| | | | | ZM-LT-7-1, |
| | | | | ZM-PCSI-2-4, |
| | | | | ZM-PCSI-7-1, |
| | | | | ZM-PCSI-7-2, |
| | | | | ZM-PCSI-7-3, |
| | | | | ZM-SCBR-7-1, |
| | | | | ZM-SWCBR-7-1, |

TABLE 3-continued

Using reverse genetics in *Arabidopsis* (using the GARLIC collection as described in Example 2), a number of *Arabidopsis* genes are identified that are required for disease resistance. Genes from mutant plants which, upon infection with the bacterial pathogen *Pseudomonas syringae*, show more severe disease symptoms as compared to the wild-type plants are searched for similar rice genes. The rice orthologs are the identified in Column A.
Column B refers to rice genes found to be induced by infection of rice plants with the fungal pathogen *Magnaporthe grisea*. Plant samples are profiled on the rice chip and the data analyzed according to Example 4 and 6 . . .
Column C and D identifies public QTLs to which the genes in the SEQ ID column are mapped.

| SEQ ID | A | B | C | D |
|---|---|---|---|---|
| | | | | ZM-SWCBR-7-2, ZM-SWCBR-7-3 |
| 93 | — | X | — | — |
| 95 | — | X | — | — |
| 97 | X | — | — | — |
| 101 | — | X | — | — |
| 103 | — | X | — | — |
| 105 | — | X | — | — |
| 107 | — | X | — | — |
| 109 | — | X | OS-XANLL-11-1 | ZM-APIT-6-1, ZM-AUT-6-1, ZM-CELW-6-1, ZM-CRR-4-3, ZM-CRR-4-5, ZM-CRR-6-5, ZM-CRR-6-6, ZM-CSVEG-4-2, ZM-CSVSG-4-1, ZM-GLS-6-1, ZM-HPVI-6-1, ZM-LVI-6-1, ZM-NLBDS-6-1, ZM-PCSI-4-3, ZM-PCSI-4-5, ZM-PHSI-6-2, ZM-PHSI-6-3, ZM-SWCBR-6-1, ZM-SWCBR-6-2, ZM-SWCBR-6-3 |
| 111 | — | X | — | — |
| 115 | — | X | — | — |
| 117 | — | X | — | — |
| 119 | — | X | — | — |
| 121 | — | X | — | — |
| 123 | — | X | — | — |
| 125 | — | X | — | — |
| 129 | — | X | — | — |
| 131 | — | X | — | — |
| 133 | — | X | — | — |
| 137 | — | X | — | — |
| 139 | — | X | — | — |
| 141 | — | X | — | — |
| 143 | X | — | — | — |
| 145 | X | — | — | — |
| 147 | X | — | — | — |
| 151 | — | X | — | — |
| 157 | — | X | — | — |
| 159 | — | X | — | — |
| 161 | X | — | — | — |
| 167 | — | X | OS-RYMVS-12-1, OS-VCGC-12-1, OS-WPEM-12-1, OS-WPPWL-12-1 | ZM-ECB-2-2, ZM-GLS-2-1, ZM-PCSI-2-4, ZM-CRR-4-4, ZM-CRR-4-6, ZM-CSVEG-4-1, ZM-GLS-4-1, ZM-NLBDS-4-2, ZM-NLBIP-4-1, ZM-PCSI-4-2 |
| 169 | — | X | — | — |
| 171 | — | X | — | — |
| 173 | — | X | — | — |
| 175 | — | X | — | — |
| 177 | — | X | — | — |
| 179 | — | X | — | — |
| 181 | — | X | — | — |
| 185 | — | X | — | — |
| 187 | — | X | — | — |
| 189 | — | X | — | ZM-ANMT-1-1, ZM-ANMT-1-2, ZM-APIT-1-1, ZM-APIT-1-2, ZM-AUT-1-1, ZM-AUT-1-2, ZM-CRR-1-11, ZM-CRR-1-13, ZM-CRR-1-15, ZM-DMS-1-2, ZM-GLS-1-1, ZM-LT-1-1, ZM-MSVI-1-1, ZM-NLBDS-1-1, ZM-PCSI-1-2, ZM-PCSI-1-7, ZM-SCBR-1-2, ZM-SDR-1-1, ZM-SWCBR-1-1, ZM-SWCBR-1-4, ZM-TL-1-1 |
| 193 | — | X | — | — |
| 195 | — | X | — | — |
| 197 | — | X | — | — |
| 199 | — | X | — | — |
| 201 | — | X | — | — |
| 203 | — | X | — | — |
| 205 | — | X | — | — |
| 209 | — | X | — | — |
| 211 | — | X | — | — |
| 213 | — | X | — | — |
| 215 | — | X | — | — |
| 217 | — | X | — | — |
| 219 | — | X | — | — |
| 221 | — | X | — | — |
| 227 | — | X | — | — |
| 229 | — | X | — | — |
| 231 | — | X | — | — |
| 235 | — | X | — | — |
| 237 | — | X | — | — |
| 239 | — | X | — | — |
| 241 | — | X | — | — |
| 243 | — | X | — | — |
| 245 | — | X | — | — |
| 247 | — | X | — | — |
| 249 | — | X | — | — |
| 251 | — | X | — | — |
| 255 | — | X | — | — |
| 257 | — | X | OS-RYMVa-1-1, OS-RYMVb-1-1, OS-RYMVc-1-1, OS-RYMVd-1-1, OS-RYMVe-1-1, OS-VCF-1-1, | — |

TABLE 3-continued

Using reverse genetics in *Arabidopsis* (using the GARLIC collection as described in Example 2), a number of *Arabidopsis* genes are identified that are required for disease resistance. Genes from mutant plants which, upon infection with the bacterial pathogen *Pseudomonas syringae*, show more severe disease symptoms as compared to the wild-type plants are searched for similar rice genes. The rice orthologs are the identified in Column A.
Column B refers to rice genes found to be induced by infection of rice plants with the fungal pathogen *Magnaporthe grisea*. Plant samples are profiled on the rice chip and the data analyzed according to Example 4 and 6 . . .
Column C and D identifies public QTLs to which the genes in the SEQ ID column are mapped.

| SEQ ID | A | B | C | D |
|---|---|---|---|---|
| 259 | — | X | OS-VCGC-1-1, OS-WPEM-1-1, OS-WPPWL-1-1 | — |
|  |  |  |  | FA00-197, FA00-205, FA00-208, FA00-209, FA00-211, FA00-214, FN98-161, FN99-048, FP00-103, FP00-109, FS98-066, FS98-067, ZM-APIT-2-1, ZM-CRR-2-11, ZM-CRR-7-6, ZM-CSVEG-7-1, ZM-ECB-2-2, ZM-GLS-2-1, ZM-GLS-7-2, ZM-GLS-7-2, ZM-LT-7-1, ZM-PCSI-2-4, ZM-PCSI-7-1, ZM-PCSI-7-2, ZM-PCSI-7-3, ZM-SCBR-7-1, ZM-SWCBR-7-1, ZM-SWCBR-7-2, ZM-SWCBR-7-3 |
| 261 | — | X | — | — |
| 263 | — | X | — | — |
| 265 | — | X | — | — |
| 269 | — | X | — | — |
| 275 | — | X | — | — |
| 277 | — | X | — | — |
| 281 | — | X | OS-RYMVa-1-1, OS-RYMVb-1-1, OS-RYMVc-1-1, OS-RYMVd-1-1, OS-WPPWL-1-1 | — |
| 287 | — | X | — | — |
| 289 | — | X | — | — |
| 291 | — | X | — | — |
| 297 | — | X | — | — |
| 299 | — | X | — | FA00-138 |
| 301 | — | X | — | — |
| 303 | — | X | — | — |
| 305 | — | X | — | — |
| 307 | — | X | — | — |
| 311 | — | X | — | FN98-050, FS98-027, ZM-APIT-3-1, ZM-CELW-6-1, ZM-CRR-3-6, ZM-GLS-3-2, ZM-HMAYI-3-1, ZM-HPVI-3-1, ZM-HPVI-6-1, ZM-LVI-6-1, ZM-MSVI-3-2, ZM-PCSI-3-1, ZM-PCSI-3-6, ZM-PHSI-6-2, ZM-SWCBR-6-1 |
| 315 | — | X | — | — |
| 317 | X | — | OS-SB-9-2, OS-XANLL-9-1 | FA00-200, FA00-203, FA00-204, FA00-205, FA00-271, FP00-086, FP00-103, FP00-109, FS98-091, ZM-ANMT-10-1, ZM-ANMT-10-2, ZM-APIT-10-1, ZM-APIT-10-2, ZM-AUT-10-1, ZM-AUT-10-2, ZM-CRR-7-5, ZM-CRR-7-6, ZM-ECB-7-1, ZM-GLS-7-1, ZM-GLS-7-2, ZM-MSVI-10-1, ZM-SCBR-7-1, ZM-SWCBR-7-1, ZM-SWCBR-7-3 |
| 319 | — | X | OS-BP-3-1, OS-BPHAS-3-1B, OS-BPHFR-3-1, OS-LS-3-3, OS-WPPWL-8-1, OS-XANLL-8-1 | FA00-255, ZM-ADCNLB-9-1, ZM-CRR-9-2, ZM-CRR-9-3, ZM-CRR-9-5, ZM-CSVEG-9-1, ZM-NLBDS-9-1, ZM-NLBIP-9-1, ZM-PCSI-9-2, ZM-PCSI-9-3, ZM-SWCBR-9-1, ZM-SWCBR-9-3, ZM-SWCBR-9-4 |
| 327 | — | X | — | — |
| 331 | — | X | — | ZM-APIT-2-1, ZM-CRR-2-11, ZM-ECB-2-2, ZM-GLS-2-1, ZM-PCSI-2-4 |
| 333 | — | X | — | — |
| 335 | — | X | — | ZM-APIT-6-1, ZM-AUT-6-1, ZM-CRR-6-5, ZM-CRR-6-6, ZM-CRR-8-6, ZM-CRR-8-7, ZM-GLS-6-1, ZM-NLBDS-6-1, ZM-NLBDS-8-2, ZM-PHSI-8-1, ZM-SWCBR-6-2, ZM-SWCBR-8-1 |

TABLE 3-continued

Using reverse genetics in *Arabidopsis* (using the GARLIC collection as described in Example 2), a number of *Arabidopsis* genes are identified that are required for disease resistance. Genes from mutant plants which, upon infection with the bacterial pathogen *Pseudomonas syringae*, show more severe disease symptoms as compared to the wild-type plants are searched for similar rice genes. The rice orthologs are the identified in Column A.
Column B refers to rice genes found to be induced by infection of rice plants with the fungal pathogen *Magnaporthe grisea*. Plant samples are profiled on the rice chip and the data analyzed according to Example 4 and 6 . . .
Column C and D identifies public QTLs to which the genes in the SEQ ID column are mapped.

| SEQ ID | A | B | C | D |
|---|---|---|---|---|
| 337 | — | X | — | — |
| 339 | — | X | — | — |
| 341 | — | X | — | — |
| 343 | — | X | — | — |
| 345 | — | X | — | — |
| 349 | — | X | — | — |
| 351 | — | X | — | — |
| 353 | — | X | — | — |
| 357 | — | X | — | — |
| 359 | — | X | — | — |
| 365 | — | X | — | — |
| 367 | — | X | — | — |
| 369 | — | X | — | — |
| 371 | — | X | — | — |
| 375 | — | X | — | — |
| 377 | X | — | — | ZM-CRR-4-3, ZM-CRR-4-4, ZM-CRR-4-6, ZM-CSVEG-4-1, ZM-LT-4-1, ZM-NLBDS-4-1, ZM-NLBDS-4-2, ZM-PCSI-4-1, ZM-PCSI-4-2 |
| 379 | — | X | — | — |
| 381 | — | X | — | — |
| 383 | — | X | — | — |
| 385 | — | X | — | — |
| 391 | — | X | — | — |
| 393 | — | X | — | — |
| 397 | — | X | — | — |
| 399 | — | X | — | — |
| 401 | — | X | — | — |
| 403 | — | X | — | — |
| 405 | X | — | — | — |
| 407 | — | X | — | — |
| 411 | — | X | — | ZM-ANMT-10-2, ZM-APIT-10-2, ZM-AUT-10-2, ZM-CRR-10-4, ZM-CSVEG-10-1, ZM-PCSI-10-1, ZM-PCSI-10-2, ZM-TL-10-1 |
| 413 | — | X | — | — |
| 415 | — | X | — | — |
| 417 | — | X | — | — |
| 419 | — | X | — | — |
| 421 | — | X | — | — |
| 425 | — | X | — | — |
| 427 | X | — | OS-BP-3-1, OS-BPHAS-3-1B, OS-BPHFR-3-1, OS-LS-3-3 | ZM-ADCNLB-9-1, ZM-CRR-9-2, ZM-CRR-9-3, ZM-CRR-9-5, ZM-CSVEG-9-1, ZM-NLBDS-9-1, ZM-NLBIP-9-1, ZM-PCSI-9-2, ZM-PCSI-9-3, ZM-SWCBR-9-1, ZM-SWCBR-9-3, ZM-SWCBR-9-4 |
| 439 | — | X | — | — |
| 441 | — | X | — | — |
| 443 | — | X | — | — |
| 445 | — | X | — | — |
| 451 | — | X | — | — |
| 455 | — | X | — | — |
| 461 | — | X | OS-BPHAO-1-1, OS-BPHRSB-1-1, OS-BPHT-1-2 | ZM-APIT-6-1, ZM-AUT-6-1, ZM-CRR-4-4, ZM-CRR-4-6, ZM-CRR-6-5, ZM-CRR-6-6, ZM-CSVEG-4-1, ZM-GLS-4-1, ZM-GLS-6-1, ZM-NLBDS-4-2, ZM-NLBDS-6-1, ZM-NLBIP-4-1, ZM-PCSI-4-2, ZM-SWCBR-6-2 |
| 465 | — | X | — | — |
| 467 | — | X | — | — |
| 469 | — | X | — | — |
| 471 | — | X | — | — |
| 475 | X | — | — | — |
| 477 | — | X | — | — |
| 481 | — | X | — | ZM-NLBDS-9-2, ZM-SWCBR-9-2 |
| 483 | — | X | — | — |
| 487 | — | X | — | — |
| 489 | — | X | — | — |
| 491 | — | X | — | — |
| 493 | — | X | OS-LS-1-1 | ZM-ADCNLB-3-1, ZM-ADCNLB-3-2, ZM-APIT-3-2, ZM-APIT-6-1, ZM-APIT-9-1, ZM-AUT-3-1, ZM-AUT-6-1, ZM-CRR-1-10, ZM-CRR-1-12, ZM-CRR-3-7, ZM-CRR-3-8, ZM-CRR-3-9, ZM-CRR-6-5, ZM-CRR-9-4, ZM-CSVEG-1-1, ZM-DMS-9-1, ZM-ECB-2-2, ZM-ECB-9-1, ZM-GLS-2-1, ZM-GLS-3-1, ZM-GLS-3-1, ZM-GLS-3-1, ZM-GLS-3-1, ZM-GLS-3-2, ZM-GLS-3-2, |

TABLE 3-continued

Using reverse genetics in *Arabidopsis* (using the GARLIC collection as described in Example 2), a number of *Arabidopsis* genes are identified that are required for disease resistance. Genes from mutant plants which, upon infection with the bacterial pathogen *Pseudomonas syringae*, show more severe disease symptoms as compared to the wild-type plants are searched for similar rice genes. The rice orthologs are the identified in Column A.
Column B refers to rice genes found to be induced by infection of rice plants with the fungal pathogen *Magnaporthe grisea*. Plant samples are profiled on the rice chip and the data analyzed according to Example 4 and 6 . . .
Column C and D identifies public QTLs to which the genes in the SEQ ID column are mapped.

| SEQ ID | A | B | C | D |
|---|---|---|---|---|
| | | | | ZM-GLS-6-1, ZM-LT-1-2, ZM-MSVI-3-1, ZM-MSVI-9-1, ZM-NLBDS-3-2, ZM-NLBDS-3-5, ZM-NLBDS-6-1, ZM-NLBDS-9-2, ZM-NLBIP-3-1, ZM-PCSI-1-4, ZM-PCSI-1-6, ZM-PCSI-2-4, ZM-PCSI-3-1, ZM-PCSI-3-2, ZM-PCSI-3-3, ZM-PCSI-3-4, ZM-PCSI-3-5, ZM-PCSI-3-6, ZM-PCSI-9-1, ZM-PHSI-6-3, ZM-SWCBR-3-1, ZM-SWCBR-3-2, ZM-SWCBR-6-2, ZM-SWCBR-6-3, ZM-SWCBR-9-2, ZM-TL-1-1, ZM-TL-3-1 |
| 497 | — | X | — | — |
| 499 | — | X | — | — |
| 501 | — | X | — | — |
| 503 | — | X | — | — |
| 507 | X | — | OS-RYMVa-1-1, OS-RYMVb-1-1, OS-RYMVc-1-1, OS-RYMVd-1-1, OS-RYMVe-1-1, OS-VCF-1-1, OS-WPEM-1-1, OS-WPPWL-1-1 | ZM-GLS-3-2, ZM-PCSI-3-1, ZM-PCSI-3-6 |
| 509 | — | X | OS-BPHRFS-4-1, OS-XANLL-4-1 | |
| | | | | ZM-ANMT-2-1, ZM-MSVI-2-1 |
| 513 | — | X | OS-VCGC-2-1 | ZM-CRR-4-4, ZM-CRR-4-6, ZM-CSVEG-4-1, ZM-GLS-4-1, ZM-NLBDS-4-2, ZM-NLBIP-4-1, ZM-PCSI-4-2 |
| 515 | — | X | — | — |
| 519 | — | X | — | — |
| 521 | — | X | — | — |
| 523 | — | X | — | — |
| 525 | — | X | — | — |
| 527 | — | X | — | — |
| 529 | — | X | — | — |
| | | | | ZM-ANMT-5-1, ZM-CELW-6-1, ZM-CRR-5-6, ZM-CRR-9-5, ZM-ECB-9-2, ZM-HPVI-6-1, ZM-LVI-6-1, ZM-NLBDS-9-2, ZM-PCSI-5-1, ZM-PCSI-5-2, ZM-PCSI-5-3, ZM-PCSI-5-5, ZM-PHSI-6-2, ZM-SWCBR-6-1, ZM-SWCBR-9-2, ZM-TL-9-1 |
| 533 | — | X | — | — |
| 535 | — | X | — | — |
| 537 | — | X | — | — |
| 539 | — | X | — | — |
| 541 | — | X | — | — |
| 543 | — | X | — | — |
| 545 | — | X | — | — |
| 547 | — | X | — | — |
| 549 | — | X | — | — |
| 551 | — | X | — | — |
| 553 | — | X | — | — |
| 555 | — | X | — | — |
| 557 | — | X | — | — |
| 559 | — | X | — | — |
| 561 | — | X | — | — |
| 563 | — | X | — | — |
| 565 | — | X | — | — |
| 567 | — | X | — | — |
| 191 | — | X | — | — |
| 435 | — | X | — | — |
| 459 | — | X | — | — |
| 295 | — | X | — | — |
| 293 | — | X | — | ZM-ANMT-5-1, ZM-APIT-6-1, ZM-AUT-6-1, ZM-CRR-5-6, ZM-CRR-6-4, ZM-CRR-6-5, ZM-CRR-8-6, ZM-CRR-8-7, ZM-GLS-6-1, ZM-GLS-8-1, ZM-NLBDS-6-1, ZM-NLBDS-8-1, ZM-NLBIP-8-1, ZM-PCSI-5-1, ZM-PCSI-5-2, ZM-PCSI-5-3, ZM-PCSI-5-5, ZM-PCSI-6-1, ZM-PHSI-6-1, ZM-PHSI-6-3, ZM-SCBR-8-1, ZM-SDR-6-1, ZM-SDR-8-1, ZM-SWCBR-6-2, ZM-SWCBR-6-3, ZM-SWCBR-8-2 |
| 207 | X | — | — | — |
| | | | | ZM-ANMT-1-1, ZM-ANMT-1-2, ZM-APIT-1-1, |

TABLE 3-continued

Using reverse genetics in *Arabidopsis* (using the GARLIC collection as described in Example 2), a number of *Arabidopsis* genes are identified that are required for disease resistance. Genes from mutant plants which, upon infection with the bacterial pathogen *Pseudomonas syringae*, show more severe disease symptoms as compared to the wild-type plants are searched for similar rice genes. The rice orthologs are the identified in Column A.
Column B refers to rice genes found to be induced by infection of rice plants with the fungal pathogen *Magnaporthe grisea*. Plant samples are profiled on the rice chip and the data analyzed according to Example 4 and 6 . . .
Column C and D identifies public QTLs to which the genes in the SEQ ID column are mapped.

| SEQ ID | A | B | C | D |
|---|---|---|---|---|
| | | | | ZM-APIT-1-2, |
| | | | | ZM-AUT-1-1, |
| | | | | ZM-AUT-1-2, |
| | | | | ZM-CRR-1-11, |
| | | | | ZM-CRR-1-13, |
| | | | | ZM-CRR-1-15, |
| | | | | ZM-CRR-4-4, |
| | | | | ZM-CRR-4-6, |
| | | | | ZM-CSVEG-4-1, |
| | | | | ZM-GLS-1-1, |
| | | | | ZM-GLS-1-1, |
| | | | | ZM-GLS-4-1, |
| | | | | ZM-LT-1-1, |
| | | | | ZM-MSVI-1-1, |
| | | | | ZM-NLBDS-1-1, |
| | | | | ZM-NLBDS-4-2, |
| | | | | ZM-NLBIP-4-1, |
| | | | | ZM-PCSI-1-2, |
| | | | | ZM-PCSI-1-3, |
| | | | | ZM-PCSI-1-5, |
| | | | | ZM-PCSI-1-7, |
| | | | | ZM-PCSI-4-2, |
| | | | | ZM-SCBR-1-1, |
| | | | | ZM-SCBR-1-2, |
| | | | | ZM-SDR-1-1, |
| | | | | ZM-SWCBR-1-1, |
| | | | | ZM-SWCBR-1-3, |
| | | | | ZM-SWCBR-1-4 |
| 17 | — | X | OS-LS-3-1 | |
| | | | | ZM-APIT-2-1, |
| | | | | ZM-CRR-2-11, |
| | | | | ZM-CRR-4-4, |
| | | | | ZM-CRR-4-6, |
| | | | | ZM-CSVEG-4-1, |
| | | | | ZM-ECB-2-2, |
| | | | | ZM-GLS-2-1, |
| | | | | ZM-GLS-4-1, |
| | | | | ZM-MSVI-1-2, |
| | | | | ZM-NLBDS-4-2, |
| | | | | ZM-NLBIP-4-1, |
| | | | | ZM-PCSI-2-4, |
| | | | | ZM-PCSI-4-2 |
| 3 | — | X | — | — |
| 13 | — | X | OS-BPHRFS-4-1, | , |
| | | | OS-VCGC-4-1, | |
| | | | OS-XANLL-4-1 | |
| | | | | ZM-ANMT-2-1, |
| | | | | ZM-APIT-2-1, |
| | | | | ZM-CRR-1-14, |
| | | | | ZM-CRR-2-11, |
| | | | | ZM-MSVI-2-1, |
| | | | | ZM-PCSI-1-1, |
| | | | | ZM-SWCBR-1-2, |
| | | | | ZM-SWCBR-1-5 |
| 15 | — | X | — | — |
| 31 | X | — | — | — |
| 43 | — | X | — | — |
| 47 | — | X | — | — |
| 49 | — | X | — | — |
| 59 | X | — | — | — |
| 65 | — | X | — | — |
| 73 | — | X | OS-BPHRFS-4-1, | |
| | | | OS-BPHRSB-4-1, | |
| | | | OS-VCGC-4-1, | |
| | | | OS-XANLL-4-1 | |
| | | | | ZM-ANMT-10-1, |
| | | | | ZM-ANMT-10-2, |
| | | | | ZM-APIT-10-1, |
| | | | | ZM-APIT-10-2, |
| | | | | ZM-APIT-2-1, |
| | | | | ZM-APIT-9-1, |
| | | | | ZM-AUT-10-1, |
| | | | | ZM-AUT-10-2, |
| | | | | ZM-CRR-1-10, |
| | | | | ZM-CRR-1-12, |
| | | | | ZM-CRR-1-14, |
| | | | | ZM-CRR-2-11, |
| | | | | ZM-CRR-9-4, |
| | | | | ZM-CSVEG-1-1, |
| | | | | ZM-DMS-9-1, |
| | | | | ZM-ECB-9-1, |
| | | | | ZM-LT-1-2, |
| | | | | ZM-MSVI-1-2, |
| | | | | ZM-MSVI-10-1, |
| | | | | ZM-MSVI-9-1, |
| | | | | ZM-NLBDS-10-2, |
| | | | | ZM-NLBDS-9-2, |
| | | | | ZM-PCSI-1-1, |
| | | | | ZM-PCSI-1-4, |
| | | | | ZM-PCSI-1-6, |
| | | | | ZM-PCSI-9-1, |
| | | | | ZM-SWCBR-1-2, |
| | | | | ZM-SWCBR-1-5, |
| | | | | ZM-SWCBR-9-2, |
| | | | | ZM-TL-1-1 |
| 75 | — | X | — | — |
| 77 | — | X | — | — |
| 83 | — | X | OS-BP-4-1, | |
| | | | OS-RYMVb-4-1 | |
| | | | | ZM-ANMT-5-1, |
| | | | | ZM-ANMT-5-2, |
| | | | | ZM-CRR-5-7, |
| | | | | ZM-CRR-5-9, |
| | | | | ZM-GLS-5-1, |
| | | | | ZM-NLBDS-5-4, |
| | | | | ZM-NLBDS-5-5, |
| | | | | ZM-PCSI-5-1, |
| | | | | ZM-PCSI-5-2, |
| | | | | ZM-PCSI-5-3, |
| | | | | ZM-PCSI-5-4, |
| | | | | ZM-PCSI-5-5, |
| | | | | ZM-PCSI-5-6, |
| | | | | ZM-PHSI-5-1, |
| | | | | ZM-SWCBR-9-1, |
| | | | | ZM-TL-5-1 |
| 85 | — | X | — | — |
| 99 | — | X | — | — |
| 113 | — | X | OS-EM-1-1, | |
| | | | OS-GWL-1-1, | |
| | | | OS-RYMVa-1-1, | |
| | | | OS-RYMVb-1-1, | |
| | | | OS-RYMVc-1-1, | ZM-AUT-8-1, |
| | | | OS-RYMVd-1-1, | ZM-CRR-8-6, |
| | | | OS-RYMVe-1-1, | ZM-CRR-8-7, |
| | | | OS-VCF-1-1, | ZM-GLS-3-2, |
| | | | OS-VCGC-1-1, | ZM-GLS-8-1, |

TABLE 3-continued

Using reverse genetics in *Arabidopsis* (using the GARLIC collection as described in Example 2), a number of *Arabidopsis* genes are identified that are required for disease resistance. Genes from mutant plants which, upon infection with the bacterial pathogen *Pseudomonas syringae*, show more severe disease symptoms as compared to the wild-type plants are searched for similar rice genes. The rice orthologs are the identified in Column A.
Column B refers to rice genes found to be induced by infection of rice plants with the fungal pathogen *Magnaporthe grisea*. Plant samples are profiled on the rice chip and the data analyzed according to Example 4 and 6 . . .
Column C and D identifies public QTLs to which the genes in the SEQ ID column are mapped.

| SEQ ID | A | B | C | D |
|---|---|---|---|---|
| | | | OS-WPEM-1-1 | ZM-GLS-8-1, ZM-MSVI-8-1, ZM-NLBDS-8-1, ZM-NLBIP-8-1, ZM-PCSI-3-1, ZM-PCSI-3-6, ZM-PCSI-8-1, ZM-PHSI-8-2, ZM-SCBR-8-1, ZM-SDR-8-1, ZM-SWCBR-8-2 |
| 127 | — | X | — | — |
| 135 | — | X | OS-SB-9-1 | |
| 149 | — | X | OS-RYMVa-1-1, OS-RYMVc-1-1 | ZM-CRR-2-10, ZM-CRR-7-5, ZM-ECB-7-1, ZM-GLS-2-1, ZM-GLS-7-1, ZM-NLBDS-2-3, ZM-PCSI-2-3, ZM-PCSI-2-7 |
| 153 | — | X | OS-LS-5-1 | ZM-ANMT-8-1, ZM-APIT-3-1, ZM-AUT-8-1, ZM-CRR-3-6, ZM-CRR-8-6, ZM-CRR-8-7, ZM-CRR-9-5, ZM-ECB-8-1, ZM-ECB-9-2, ZM-GLS-8-1, ZM-GLS-8-1, ZM-HMAYI-3-1, ZM-HPVI-3-1, ZM-LT-8-1, ZM-LT-8-2, ZM-MSVI-3-2, ZM-MSVI-8-1, ZM-NLBDS-8-1, ZM-NLBDS-8-3, ZM-NLBDS-9-2, ZM-NLBIP-8-1, ZM-PCSI-8-1, ZM-PHSI-8-2, ZM-PHSI-9-1, ZM-SCBR-8-1, ZM-SCBR-8-2, ZM-SCBR-9-1, ZM-SDR-8-1, ZM-SWCBR-8-2, ZM-SWCBR-8-3, ZM-SWCBR-8-4, ZM-SWCBR-9-2, ZM-SWCBR-9-3, ZM-TL-9-1 |
| 155 | X | X | OS-LS-3-1 | |
| | | | | ZM-ANMT-10-2, ZM-ANMT-5-1, ZM-APIT-10-2, ZM-APIT-2-1, ZM-AUT-10-2, ZM-CRR-1-16, ZM-CRR-10-4, ZM-CRR-2-11, ZM-CRR-4-4, ZM-CRR-4-6, ZM-CRR-5-6, ZM-CSVEG-10-1, ZM-CSVEG-4-1, ZM-ECB-2-2, ZM-GLS-2-1, ZM-GLS-4-1, ZM-MSVI-1-2, ZM-NLBDS-10-2, ZM-NLBDS-4-2, ZM-NLBIP-4-1, ZM-PCSI-1-4, ZM-PCSI-10-1, ZM-PCSI-10-2, ZM-PCSI-2-4, ZM-PCSI-4-2, ZM-PCSI-5-1, ZM-PCSI-5-2, ZM-PCSI-5-3, ZM-PCSI-5-5, ZM-SCBR-1-3, ZM-SWCBR-1-2, ZM-SWCBR-1-5, ZM-TL-10-1 |
| 163 | — | X | — | — |
| 165 | — | X | OS-RYMVS-9-1 | ZM-ANMT-1-1, ZM-ANMT-1-2, ZM-APIT-1-1, ZM-APIT-1-2, ZM-AUT-1-1, ZM-AUT-1-2, ZM-CRR-1-11, ZM-CRR-1-13, ZM-CRR-1-15, ZM-CRR-7-5, ZM-CRR-7-6, ZM-DMS-1-2, ZM-ECB-7-1, ZM-GLS-1-1, ZM-GLS-7-1, ZM-GLS-7-2, ZM-LT-1-1, ZM-MSVI-1-1, ZM-NLBDS-1-1, ZM-PCSI-1-2, ZM-PCSI-1-7, ZM-SCBR-1-2, ZM-SCBR-7-1, ZM-SDR-1-1, ZM-SWCBR-1-1, ZM-SWCBR-1-4, ZM-SWCBR-7-1, ZM-SWCBR-7-3, ZM-TL-1-1 |
| 183 | — | X | — | ZM-ADCNLB-3-2, ZM-ANMT-10-1, |

TABLE 3-continued

Using reverse genetics in *Arabidopsis* (using the GARLIC collection as described in Example 2), a number of *Arabidopsis* genes are identified that are required for disease resistance. Genes from mutant plants which, upon infection with the bacterial pathogen *Pseudomonas syringae*, show more severe disease symptoms as compared to the wild-type plants are searched for similar rice genes. The rice orthologs are the identified in Column A.
Column B refers to rice genes found to be induced by infection of rice plants with the fungal pathogen *Magnaporthe grisea*. Plant samples are profiled on the rice chip and the data analyzed according to Example 4 and 6 . . .
Column C and D identifies public QTLs to which the genes in the SEQ ID column are mapped.

| SEQ ID | A | B | C | D |
|---|---|---|---|---|
|  |  |  |  | ZM-ANMT-10-2, ZM-ANMT-2-1, ZM-APIT-10-1, ZM-APIT-10-2, ZM-AUT-10-1, ZM-AUT-10-2, ZM-AUT-2-1, ZM-CRR-1-14, ZM-CRR-10-4, ZM-CRR-3-7, ZM-CRR-3-8, ZM-CRR-3-9, ZM-CRR-4-4, ZM-CRR-4-6, ZM-CRR-8-6, ZM-CRR-8-7, ZM-CSVEG-10-1, ZM-CSVEG-2-1, ZM-CSVEG-4-1, ZM-CSVSG-2-1, ZM-GLS-3-1, ZM-GLS-3-2, ZM-GLS-4-1, ZM-GLS-4-1, ZM-MSVI-10-1, ZM-MSVI-2-1, ZM-NLBDS-3-2, ZM-NLBDS-3-5, ZM-NLBDS-4-2, ZM-NLBDS-8-2, ZM-NLBDS-9-2, ZM-NLBIP-4-1, ZM-PCSI-1-1, ZM-PCSI-10-1, ZM-PCSI-10-2, ZM-PCSI-2-1, ZM-PCSI-2-5, ZM-PCSI-2-9, ZM-PCSI-3-1, ZM-PCSI-3-4, ZM-PCSI-3-5, ZM-PCSI-3-6, ZM-PCSI-4-2, ZM-PHSI-8-1, ZM-SWCBR-1-2, ZM-SWCBR-1-5, ZM-SWCBR-8-1, ZM-SWCBR-9-2, ZM-TL-10-1 |
| 223 | — | X | — | — |
| 225 | X | — | — | — |
| 233 | — | X | — | — |
| 253 | — | X | — | — |
| 267 | — | X | OS-XANLL-11-1 | — |
|  |  |  |  | ZM-APIT-6-1, ZM-AUT-6-1, ZM-CELW-6-1, ZM-CRR-4-3, ZM-CRR-4-5, ZM-CRR-6-5, ZM-CRR-6-6, ZM-CSVEG-4-2, ZM-CSVSG-4-1, ZM-GLS-6-1, ZM-HPVI-6-1, ZM-LVI-6-1, ZM-NLBDS-6-1, ZM-PCSI-4-3, ZM-PCSI-4-5, ZM-PHSI-6-2, ZM-PHSI-6-3, ZM-SWCBR-6-1, ZM-SWCBR-6-2, ZM-SWCBR-6-3 |
| 271 | — | X | OS-BP-3-1, OS-LS-3-3 |  |
|  |  |  |  | ZM-ADCNLB-9-1, ZM-CELW-6-1, ZM-CRR-1-14, ZM-CRR-9-2, ZM-CRR-9-3, ZM-CRR-9-5, ZM-CSVEG-9-1, ZM-CSVSG-1-1, ZM-DMS-1-1, ZM-HPVI-6-1, ZM-LVI-6-1, ZM-NLBDS-9-1, ZM-NLBDS-9-2, ZM-NLBIP-9-1, ZM-PCSI-1-1, ZM-PCSI-1-5, ZM-PCSI-9-2, ZM-PCSI-9-3, ZM-PHSI-6-2, ZM-PHSI-9-1, ZM-SCBR-1-1, ZM-SCBR-9-1, ZM-SWCBR-1-2, ZM-SWCBR-1-3, ZM-SWCBR-1-6, ZM-SWCBR-6-1, ZM-SWCBR-9-1, ZM-SWCBR-9-2, ZM-SWCBR-9-3, ZM-SWCBR-9-4 |
| 273 | — | X | — | — |
| 279 | — | X | OS-WPPWL-8-1 |  |
|  |  |  |  | ZM-ANMT-2-1, ZM-AUT-2-1, ZM-CRR-2-10, ZM-CRR-2-9, ZM-CRR-4-4, ZM-CRR-4-6, ZM-CSVEG-2-1, ZM-CSVEG-4-1, ZM-CSVSG-2-1, ZM-ECB-2-1, ZM-GLS-4-1, ZM-MSVI-2-1, ZM-MSVI-2-2, ZM-NLBDS-4-2, ZM-NLBIP-4-1, ZM-PCSI-2-1, ZM-PCSI-2-2, ZM-PCSI-2-5, |

TABLE 3-continued

Using reverse genetics in *Arabidopsis* (using the GARLIC collection as described in Example 2), a number of *Arabidopsis* genes are identified that are required for disease resistance. Genes from mutant plants which, upon infection with the bacterial pathogen *Pseudomonas syringae*, show more severe disease symptoms as compared to the wild-type plants are searched for similar rice genes. The rice orthologs are the identified in Column A.
Column B refers to rice genes found to be induced by infection of rice plants with the fungal pathogen *Magnaporthe grisea*. Plant samples are profiled on the rice chip and the data analyzed according to Example 4 and 6 . . .
Column C and D identifies public QTLs to which the genes in the SEQ ID column are mapped.

| SEQ ID | A | B | C | D |
|---|---|---|---|---|
| 283 | — | X | OS-RYMVa-1-1, OS-RYMVb-1-1, OS-RYMVc-1-1, OS-RYMVd-1-1, OS-WPPWL-1-1 | ZM-PCSI-2-7, ZM-PCSI-2-9, ZM-PCSI-4-2 — |
| 285 | — | X | — | — |
| 309 | — | X | — | — |
| 313 | — | X | — | — |
| 321 | X | — | OS-WPEM-2-1 | — |
| 323 | — | X | OS-LS-1-1 | ZM-ADCNLB-5-3, ZM-CRR-4-3, ZM-CRR-4-5, ZM-CRR-8-6, ZM-CRR-8-7, ZM-DMS-1-2, ZM-LVI-4-1, ZM-NLBDS-4-2, ZM-NLBDS-5-3, ZM-NLBDS-8-2, ZM-NLBDS-9-2, ZM-PCSI-4-6, ZM-PHSI-4-1, ZM-PHSI-8-1, ZM-SDR-5-2, ZM-SWCBR-5-2, ZM-SWCBR-8-1, ZM-SWCBR-9-2, ZM-TL-1-1 |
| 325 | X | — | — | ZM-ADCNLB-3-1, ZM-ADCNLB-3-2, ZM-CRR-3-7, ZM-CRR-3-8, ZM-CRR-3-9, ZM-ECB-2-2, ZM-GLS-2-1, ZM-GLS-3-1, ZM-GLS-3-1, ZM-GLS-3-2, ZM-GLS-3-2, ZM-NLBDS-3-2, ZM-NLBDS-3-5, ZM-NLBIP-3-1, ZM-PCSI-2-4, ZM-PCSI-3-1, ZM-PCSI-3-2, ZM-PCSI-3-3, ZM-PCSI-3-4, ZM-PCSI-3-5, ZM-PCSI-3-6, ZM-SWCBR-3-1 |
| 329 | X | — | — | — |
| 347 | X | — | — | — |
| 355 | — | X | OS-EM-1-1, OS-GWL-1-1, OS-RYMVa-1-1, OS-RYMVb-1-1, OS-RYMVc-1-1, OS-RYMVd-1-1, OS-RYMVe-1-1, OS-VCF-1-1, OS-VCGC-1-1, OS-WPEM-1-1, OS-WPPWL-1-1 | ZM-GLS-3-2, ZM-PCSI-3-1, ZM-PCSI-3-6 |
| 361 | — | X | — | — |
| 363 | — | X | — | — |
| 373 | — | X | — | — |
| 387 | — | X | — | — |
| 389 | — | X | — | — |
| 395 | — | X | — | — |
| 409 | — | X | — | — |
| 423 | — | X | — | — |
| 429 | — | X | OS-WPEM-10-1, OS-WPPWL-10-1 | ZM-ADCNLB-5-1, ZM-ADCNLB-5-2, ZM-ADCNLB-9-1, ZM-ANMT-8-1, ZM-CELW-5-1, ZM-CELW-6-1, ZM-CRR-4-4, ZM-CRR-4-6, ZM-CRR-5-7, ZM-CRR-9-2, ZM-CRR-9-3, ZM-CRR-9-5, ZM-CSVEG-4-1, ZM-CSVEG-9-1, ZM-ECB-5-1, ZM-ECB-8-1, ZM-ETURI-5-1, ZM-GLS-4-1, ZM-GLS-5-2, ZM-GLS-5-2, ZM-HPVI-6-1, ZM-LT-5-1, ZM-LT-8-1, ZM-LT-8-2, ZM-LVI-5-1, ZM-LVI-6-1, ZM-NLBDS-4-2, ZM-NLBDS-5-1, ZM-NLBDS-5-2, ZM-NLBDS-8-3, ZM-NLBDS-9-1, ZM-NLBDS-9-2, ZM-NLBIP-4-1, ZM-NLBIP-5-1, ZM-NLBIP-9-1, ZM-PCSI-4-2, ZM-PCSI-5-7, ZM-PCSI-9-2, ZM-PCSI-9-3, ZM-PHSI-6-2, ZM-SCBR-5-1, ZM-SCBR-8-2, ZM-SDR-5-1, ZM-SDR-5-1, ZM-SWCBR-5-1, ZM-SWCBR-5-2, ZM-SWCBR-5-3, ZM-SWCBR-6-1, |

TABLE 3-continued

Using reverse genetics in *Arabidopsis* (using the GARLIC collection as described in Example 2), a number of *Arabidopsis* genes are identified that are required for disease resistance. Genes from mutant plants which, upon infection with the bacterial pathogen *Pseudomonas syringae*, show more severe disease symptoms as compared to the wild-type plants are searched for similar rice genes. The rice orthologs are the identified in Column A.
Column B refers to rice genes found to be induced by infection of rice plants with the fungal pathogen *Magnaporthe grisea*. Plant samples are profiled on the rice chip and the data analyzed according to Example 4 and 6 . . .
Column C and D identifies public QTLs to which the genes in the SEQ ID column are mapped.

| SEQ ID | A | B | C | D |
|---|---|---|---|---|
| 431 | — | X | OS-LS-1-1 | ZM-SWCBR-8-3, ZM-SWCBR-8-4, ZM-SWCBR-9-1, ZM-SWCBR-9-2, ZM-SWCBR-9-4 |
| 433 | — | X | — | ZM-ADCNLB-3-2, ZM-APIT-3-2, ZM-APIT-6-1, ZM-APIT-9-1, ZM-AUT-3-1, ZM-AUT-6-1, ZM-CRR-3-7, ZM-CRR-3-8, ZM-CRR-3-9, ZM-CRR-6-4, ZM-CRR-6-5, ZM-CRR-7-5, ZM-CRR-9-4, ZM-DMS-9-1, ZM-ECB-7-1, ZM-ECB-8-1, ZM-ECB-9-1, ZM-GLS-3-1, ZM-GLS-3-1, ZM-GLS-3-1, ZM-GLS-6-1, ZM-GLS-7-1, ZM-LT-8-2, ZM-MSVI-3-1, ZM-MSVI-9-1, ZM-NLBDS-3-2, ZM-NLBDS-3-5, ZM-NLBDS-6-1, ZM-NLBDS-9-2, ZM-PCSI-3-3, ZM-PCSI-3-4, ZM-PCSI-3-5, ZM-PCSI-6-1, ZM-PCSI-9-1, ZM-PHSI-6-3, ZM-SDR-6-1, ZM-SWCBR-3-1, ZM-SWCBR-3-2, ZM-SWCBR-6-2, ZM-SWCBR-6-3, ZM-SWCBR-8-4, ZM-SWCBR-9-2, ZM-TL-3-1, ZM-CRR-4-4, ZM-CRR-4-6, ZM-CSVEG-4-1, ZM-GLS-4-1, ZM-NLBDS-4-2, ZM-NLBIP-4-1, ZM-PCSI-4-2 |
| 437 | — | X | OS-BP-3-1, OS-LS-3-2, OS-WPPWL-3-1 | ZM-ANMT-1-1, ZM-ANMT-1-2, ZM-APIT-1-1, ZM-APIT-1-2, ZM-AUT-1-1, ZM-AUT-1-2, ZM-CRR-1-11, ZM-CRR-1-13, ZM-CRR-4-4, ZM-CRR-4-6, ZM-CSVEG-4-1, ZM-CSVEG-1-1, ZM-DMS-1-1, ZM-GLS-1-1, ZM-GLS-4-1, ZM-MSVI-1-1, ZM-NLBDS-4-2, ZM-NLBIP-4-1, ZM-PCSI-1-1, ZM-PCSI-1-2, ZM-PCSI-1-3, ZM-PCSI-1-5, ZM-PCSI-4-2, ZM-SCBR-1-1, ZM-SWCBR-1-3, ZM-SWCBR-1-6 |
| 447 | X | — | — | — |
| 449 | — | X | — | — |
| 453 | — | X | — | — |
| 457 | — | X | — | — |
| 463 | X | — | OS-LS-1-1 | ZM-APIT-9-1, ZM-CRR-9-4, ZM-DMS-9-1, ZM-ECB-9-1, ZM-MSVI-9-1, ZM-NLBDS-9-2, ZM-PCSI-9-1, ZM-SWCBR-9-2 |
| 473 | — | X | — | — |
| 479 | — | X | — | — |
| 485 | — | X | — | — |
| 495 | — | X | — | — |
| 505 | X | — | OS-BPHRFS-4-1 | ZM-ANMT-1-1, ZM-ANMT-1-2, ZM-ANMT-2-1, ZM-APIT-1-1, ZM-APIT-1-2, ZM-AUT-1-1, ZM-AUT-1-2, ZM-AUT-2-1, ZM-CRR-1-11, ZM-CRR-1-13, ZM-CRR-1-15, ZM-CRR-4-4, ZM-CRR-4-6, ZM-CSVEG-2-1, ZM-CSVEG-4-1, ZM-CSVSG-2-1, ZM-GLS-1-1, ZM-GLS-1-1, ZM-GLS-4-1, ZM-LT-1-1, ZM-MSVI-1-1, ZM-MSVI-2-1, ZM-NLBDS-1-1, |

TABLE 3-continued

Using reverse genetics in *Arabidopsis* (using the GARLIC collection as described in Example 2), a number of *Arabidopsis* genes are identified that are required for disease resistance. Genes from mutant plants which, upon infection with the bacterial pathogen *Pseudomonas syringae*, show more severe disease symptoms as compared to the wild-type plants are searched for similar rice genes. The rice orthologs are the identified in Column A.
Column B refers to rice genes found to be induced by infection of rice plants with the fungal pathogen *Magnaporthe grisea*. Plant samples are profiled on the rice chip and the data analyzed according to Example 4 and 6 . . .
Column C and D identifies public QTLs to which the genes in the SEQ ID column are mapped.

| SEQ ID | A | B | C | D |
|---|---|---|---|---|
| | | | | ZM-NLBDS-4-2, |
| | | | | ZM-NLBIP-4-1, |
| | | | | ZM-PCSI-1-2, |
| | | | | ZM-PCSI-1-3, |
| | | | | ZM-PCSI-1-5, |
| | | | | ZM-PCSI-1-7, |
| | | | | ZM-PCSI-2-1, |
| | | | | ZM-PCSI-2-5, |
| | | | | ZM-PCSI-2-9, |
| | | | | ZM-PCSI-4-2, |
| | | | | ZM-SCBR-1-1, |
| | | | | ZM-SCBR-1-2, |
| | | | | ZM-SDR-1-1, |
| | | | | ZM-SWCBR-1-1, |
| | | | | ZM-SWCBR-1-3, |
| | | | | ZM-SWCBR-1-4 |
| 511 | — | X | — | |
| | | | | ZM-ANMT-10-1, |
| | | | | ZM-ANMT-10-2, |
| | | | | ZM-ANMT-5-1, |
| | | | | ZM-APIT-10-1, |
| | | | | ZM-APIT-10-2, |
| | | | | ZM-APIT-6-1, |
| | | | | ZM-AUT-10-1, |
| | | | | ZM-AUT-10-2, |
| | | | | ZM-AUT-6-1, |
| | | | | ZM-CELW-5-1, |
| | | | | ZM-CRR-1-14, |
| | | | | ZM-CRR-10-4, |
| | | | | ZM-CRR-5-6, |
| | | | | ZM-CRR-5-7, |
| | | | | ZM-CRR-5-9, |
| | | | | ZM-CRR-6-4, |
| | | | | ZM-CRR-6-5, |
| | | | | ZM-CRR-7-5, |
| | | | | ZM-CRR-8-6, |
| | | | | ZM-CRR-8-7, |
| | | | | ZM-CSVEG-10-1, |
| | | | | ZM-CSVSG-1-1, |
| | | | | ZM-DMS-1-1, |
| | | | | ZM-ECB-7-1, |
| | | | | ZM-ETURI-2-1, |
| | | | | ZM-GLS-5-1, |
| | | | | ZM-GLS-5-2, |
| | | | | ZM-GLS-6-1, |
| | | | | ZM-GLS-7-1, |
| | | | | ZM-GLS-8-1, |
| | | | | ZM-MSVI-10-1, |
| | | | | ZM-NLBDS-5-5, |
| | | | | ZM-NLBDS-6-1, |
| | | | | ZM-NLBDS-8-1, |
| | | | | ZM-NLBDS-8-2, |
| | | | | ZM-NLBIP-8-1, |
| | | | | ZM-PCSI-1-1, |
| | | | | ZM-PCSI-1-5, |
| | | | | ZM-PCSI-10-1, |
| | | | | ZM-PCSI-10-2, |
| | | | | ZM-PCSI-2-1, |
| | | | | ZM-PCSI-2-5, |
| | | | | ZM-PCSI-5-1, |
| | | | | ZM-PCSI-5-2, |
| | | | | ZM-PCSI-5-3, |
| | | | | ZM-PCSI-5-5, |
| | | | | ZM-PCSI-6-1, |
| | | | | ZM-PHSI-5-1, |
| | | | | ZM-PHSI-6-3, |
| | | | | ZM-PHSI-8-1, |
| | | | | ZM-SCBR-1-1, |
| | | | | ZM-SCBR-8-1, |
| | | | | ZM-SDR-5-1, |
| | | | | ZM-SDR-6-1, |
| | | | | ZM-SDR-8-1, |
| | | | | ZM-SWCBR-1-2, |
| | | | | ZM-SWCBR-1-3, |
| | | | | ZM-SWCBR-1-5, |
| | | | | ZM-SWCBR-1-6, |
| | | | | ZM-SWCBR-5-1, |
| | | | | ZM-SWCBR-6-2, |
| | | | | ZM-SWCBR-6-3, |
| | | | | ZM-SWCBR-8-1, |
| | | | | ZM-SWCBR-8-2, |
| | | | | ZM-TL-10-1 |
| 517 | — | X | — | — |
| 531 | X | — | — | |
| | | | | ZM-CRR-1-11, |
| | | | | ZM-CRR-1-13, |
| | | | | ZM-GLS-1-1, |
| | | | | ZM-PCSI-1-2, |
| | | | | ZM-PCSI-1-3, |
| | | | | ZM-PCSI-1-5, |
| | | | | ZM-SCBR-1-1, |
| | | | | ZM-SWCBR-1-3 |

A = Rice Orthologs of *Arabidopsis* Disease-Resistance Genes Identified by Reverse Genetics
B = *Magnaporthe grisea*-induced Rice genes
C = Rice_Pathogen_Resistance_QTLs
D = Maize_Pathogen_Resistance_QTLs

TABLE 4

Description of disease and pathogen resistance QTLs identified in Table 3.

QTL: OS-BP-3-1
Species: *Oryza sativa*
General Trait: PATHOGEN RESISTANCE
Specific Trait: Susceptibility to brown planthopper
Citation: THEOR APPL GENET (2001) 102: 929-934
Chromosome: 3
Flanking Markers(s):
QTL: OS-BP-4-1
Species: *Oryza sativa*
General Trait: PATHOGEN RESISTANCE
Specific Trait: Susceptibility to brown planthopper
Citation: THEOR APPL GENET (2001) 102: 929-934
Chromosome: 4
Flanking Markers(s):
QTL: OS-BPHAO-1-1
Species: *Oryza sativa*
General Trait: PATHOGEN RESISTANCE TABLE 4-continued Description of disease and pathogen resistance QTLs identified in Table 3.

Specific Trait: Brown Planthopper antixenosis - oviposition
Citation: THEOR APPL GENET (1998) 97: 1370-1379
Chromosome: 1
Flanking Markers(s):
QTL: OS-BPHAS-3-1B
Species: *Oryza sativa*
General Trait: PATHOGEN RESISTANCE
Specific Trait: Brown Planthopper antixenosis - settling
Citation: THEOR APPL GENET (1998) 97: 1370-1379
Chromosome: 3
Flanking Markers(s):
QTL: OS-BPHFR-3-1
Species: *Oryza sativa*
General Trait: PATHOGEN RESISTANCE
Specific Trait: Brown Planthopper feeding rate
Citation: THEOR APPL GENET (1998) 97: 1370-1379
Chromosome: 3
Flanking Markers(s):
QTL: OS-BPHRFS-4-1
Species: *Oryza sativa*
General Trait: PATHOGEN RESISTANCE
Specific Trait: Brown Planthopper resistance - field screening
Citation: THEOR APPL GENET (1998) 97: 1370-1379
Chromosome: 4
Flanking Markers(s):
QTL: OS-BPHRSB-1-1
Species: *Oryza sativa*
General Trait: PATHOGEN RESISTANCE
Specific Trait: Brown Planthopper resistance - seedbox screening
Citation: THEOR APPL GENET (1998) 97: 1370-1379
Chromosome: 1
Flanking Markers(s):
QTL: OS-BPHRSB-4-1
Species: *Oryza sativa*
General Trait: PATHOGEN RESISTANCE
Specific Trait: Brown Planthopper resistance - seedbox screening
Citation: THEOR APPL GENET (1998) 97: 1370-1379
Chromosome: 4
Flanking Markers(s):
QTL: OS-BPHT-1-2
Species: *Oryza sativa*
General Trait: PATHOGEN RESISTANCE
Specific Trait: Brown Planthopper tolerance
Citation: THEOR APPL GENET (1998) 97: 1370-1379
Chromosome: 1
Flanking Markers(s):
QTL: OS-EM-1-1
Species: *Oryza sativa*
General Trait: PATHOGEN RESISTANCE
Specific Trait: Egg Mortality
Citation: BREEDING SCIENCE (2000) 50: 291-296
Chromosome: 1
Flanking Markers(s):
QTL: OS-GWL-1-1
Species: *Oryza sativa*
General Trait: PATHOGEN RESISTANCE
Specific Trait: Watery lesions
Citation: BREEDING SCIENCE (2000) 50: 291-296
Chromosome: 1
Flanking Markers(s):
QTL: OS-LS-1-1
Species: *Oryza sativa*
General Trait: PATHOGEN RESISTANCE
Specific Trait: Susceptibility to bacterial leaf streak
Citation: THEOR APPL GENET (2000) 101: 286-291
Chromosome: 1
Flanking Markers(s):
QTL: OS-LS-3-1
Species: *Oryza sativa*
General Trait: PATHOGEN RESISTANCE
Specific Trait: Susceptibility to bacterial leaf streak
Citation: THEOR APPL GENET (2000) 101: 286-291
Chromosome: 3
Flanking Markers(s):
QTL: OS-LS-3-2
Species: *Oryza sativa*
General Trait: PATHOGEN RESISTANCE
Specific Trait: Susceptibility to bacterial leaf streak
Citation: THEOR APPL GENET (2000) 101: 286-291
Chromosome: 3
Flanking Markers(s):
QTL: OS-LS-3-3
Species: *Oryza sativa*
General Trait: PATHOGEN RESISTANCE
Specific Trait: Susceptibility to bacterial leaf streak
Citation: THEOR APPL GENET (2000) 101: 286-291
Chromosome: 3
Flanking Markers(s):
QTL: OS-LS-5-1
Species: *Oryza sativa*
General Trait: PATHOGEN RESISTANCE
Specific Trait: Susceptibility to bacterial leaf streak
Citation: THEOR APPL GENET (2000) 101: 286-291
Chromosome: 5
Flanking Markers(s):
QTL: OS-RYMVS-12-1
Species: *Oryza sativa*
General Trait: PATHOGEN RESISTANCE
Specific Trait: Rice yellow mottle virus resistance - symptoms
Citation: THEOR APPL GENET (1998) 97: 1145-1154
Chromosome: 12
Flanking Markers(s): 30
QTL: OS-RYMVS-9-1
Species: *Oryza sativa*
General Trait: PATHOGEN RESISTANCE
Specific Trait: Rice yellow mottle virus resistance - symptoms
Citation: THEOR APPL GENET (1998) 97: 1145-1154
Chromosome: 9
Flanking Markers(s): 78
QTL: OS-RYMVa-1-1
Species: *Oryza sativa*
General Trait: PATHOGEN RESISTANCE
Specific Trait: Rice yellow mottle virus resistance - days to heading
Citation: THEOR APPL GENET (1998) 97: 1145-1154
Chromosome: 1
Flanking Markers(s):
QTL: OS-RYMVb-1-1
Species: *Oryza sativa*
General Trait: PATHOGEN RESISTANCE
Specific Trait: Rice yellow mottle virus resistance - grain weight/plant

TABLE 4-continued

Description of disease and pathogen resistance QTLs identified in Table 3.

Citation: THEOR APPL GENET (1998)
97: 1145-1154
Chromosome: 1
Flanking Markers(s): 194
QTL: OS-RYMVb-4-1
Species: *Oryza sativa*
General Trait: PATHOGEN RESISTANCE
Specific Trait: Rice yellow mottle virus
resistance - grain
weight/plant
Citation: THEOR APPL GENET (1998)
97: 1145-1154
Chromosome: 4
Flanking Markers(s): 9
QTL: OS-RYMVc-1-1
Species: *Oryza sativa*
General Trait: PATHOGEN RESISTANCE
Specific Trait: "Rice yellow mottle virus
resistance - plant height,
early"
Citation: THEOR APPL GENET (1998)
97: 1145-1154
Chromosome: 1
Flanking Markers(s):
QTL: OS-RYMVd-1-1
Species: *Oryza sativa*
General Trait: PATHOGEN RESISTANCE
Specific Trait: Rice yellow mottle virus
resistance - plant height
Citation: THEOR APPL GENET (1998)
97: 1145-1154
Chromosome: 1
Flanking Markers(s): 181
QTL: OS-RYMVe-1-1
Species: *Oryza sativa*
General Trait: PATHOGEN RESISTANCE
Specific Trait: Rice yellow mottle virus
resistance - tiller number
Citation: THEOR APPL GENET (1998)
97: 1145-1154
Chromosome: 1
Flanking Markers(s): 196
QTL: OS-SB-9-1
Species: *Oryza sativa*
General Trait: PATHOGEN RESISTANCE
Specific Trait: Susceptibility to sheath blight
Citation: THEOR APPL GENET (2000)
101: 569-573
Chromosome: 9
Flanking Markers(s):
QTL: OS-SB-9-2
Species: *Oryza sativa*
General Trait: PATHOGEN RESISTANCE
Specific Trait: Susceptibility to sheath blight
Citation: THEOR APPL GENET (2000)
101: 569-573
Chromosome: 9
Flanking Markers(s):
QTL: OS-VCF-1-1
Species: *Oryza sativa*
General Trait: PATHOGEN RESISTANCE
Specific Trait: Virus content - field
Citation: THEOR APPL GENET (1998)
97: 1145-1154
Chromosome: 1
Flanking Markers(s): 198
QTL: OS-VCGC-1-1
Species: *Oryza sativa*
General Trait: PATHOGEN RESISTANCE
Specific Trait: Virus content - growth chamber
Citation: THEOR APPL GENET (1998)
97: 1145-1154
Chromosome: 1
Flanking Markers(s): 206
QTL: OS-VCGC-12-1
Species: *Oryza sativa*
General Trait: PATHOGEN RESISTANCE
Specific Trait: Virus content - growth chamber
Citation: THEOR APPL GENET (1998)
97: 1145-1154
Chromosome: 12
Flanking Markers(s): 30
QTL: OS-VCGC-2-1
Species: *Oryza sativa*
General Trait: PATHOGEN RESISTANCE
Specific Trait: Virus content - growth chamber
Citation: THEOR APPL GENET (1998)
97: 1145-1154
Chromosome: 2
Flanking Markers(s): 3
QTL: OS-VCGC-4-1
Species: *Oryza sativa*
General Trait: PATHOGEN RESISTANCE
Specific Trait: Virus content - growth chamber
Citation: THEOR APPL GENET (1998)
97: 1155-1161
Chromosome: 4
Flanking Markers(s): 92
QTL: OS-WPEM-1-1
Species: *Oryza sativa*
General Trait: PATHOGEN RESISTANCE
Specific Trait: "Whitebacked planthopper
infection, egg mortality"
Citation: CROP SCI (1999) 39: 1178-1183
Chromosome: 1
Flanking Markers(s): 158.1
QTL: OS-WPEM-10-1
Species: *Oryza sativa*
General Trait: PATHOGEN RESISTANCE
Specific Trait: "Whitebacked planthopper
infection, egg mortality"
Citation: CROP SCI (1999) 39: 1178-1183
Chromosome: 10
Flanking Markers(s): 0
QTL: OS-WPEM-12-1
Species: *Oryza sativa*
General Trait: PATHOGEN RESISTANCE
Specific Trait: "Whitebacked planthopper
infection, egg mortality"
Citation: CROP SCI (1999) 39: 1178-1183
Chromosome: 12
Flanking Markers(s): 38
QTL: OS-WPEM-2-1
Species: *Oryza sativa*
General Trait: PATHOGEN RESISTANCE
Specific Trait: "Whitebacked planthopper
infection, egg mortality"
Citation: CROP SCI (1999) 39: 1178-1183
Chromosome: 2
Flanking Markers(s):
QTL: OS-WPPWL-1-1
Species: *Oryza sativa*
General Trait: PATHOGEN RESISTANCE
Specific Trait: "Whitebacked planthopper
infection, percent watery
lesions"
Citation: CROP SCI (1999) 39: 1178-1183
Chromosome: 1
Flanking Markers(s): 159
QTL: OS-WPPWL-10-1
Species: *Oryza sativa*
General Trait: PATHOGEN RESISTANCE
Specific Trait: "Whitebacked planthopper
infection, percent watery
lesions"
Citation: CROP SCI (1999) 39: 1178-1183
Chromosome: 10
Flanking Markers(s): 0
QTL: OS-WPPWL-12-1
Species: *Oryza sativa*
General Trait: PATHOGEN RESISTANCE
Specific Trait: "Whitebacked planthopper

TABLE 4-continued

Description of disease and pathogen resistance QTLs identified in Table 3.

infection, percent watery
lesions"
Citation: CROP SCI (1999) 39: 1178-1183
Chromosome: 12
Flanking Markers(s): 38
QTL: OS-WPPWL-3-1
Species: *Oryza sativa*
General Trait: PATHOGEN RESISTANCE
Specific Trait: "Whitebacked planthopper
infection, percent watery
lesions"
Citation: CROP SCI (1999) 39: 1178-1183
Chromosome: 3
Flanking Markers(s): 52.6
QTL: OS-WPPWL-8-1
Species: *Oryza sativa*
General Trait: PATHOGEN RESISTANCE
Specific Trait: "Whitebacked planthopper
infection, percent watery
lesions"
Citation: CROP SCI (1999) 39: 1178-1183
Chromosome: 8
Flanking Markers(s):
QTL: OS-XANLL-11-1
Species: *Oryza sativa*
General Trait: PATHOGEN RESISTANCE
Specific Trait: "*Xanthamonas orzyae* infection,
lesion length"
Citation: MOL GEN GENET (1999) 261: 58-63
Chromosome: 11
Flanking Markers(s):
QTL: OS-XANLL-4-1
Species: *Oryza sativa*
General Trait: PATHOGEN RESISTANCE
Specific Trait: "*Xanthamonas orzyae* infection,
lesion length"
Citation: MOL GEN GENET (1999) 261: 58-63
Chromosome: 4
Flanking Markers(s):
QTL: OS-XANLL-8-1
Species: *Oryza sativa*
General Trait: PATHOGEN RESISTANCE
Specific Trait: "*Xanthamonas orzyae* infection,
lesion length"
Citation: MOL GEN GENET (1999) 261: 58-63
Chromosome: 8
Flanking Markers(s):
QTL: OS-XANLL-9-1
Species: *Oryza sativa*
General Trait: PATHOGEN RESISTANCE
Specific Trait: "*Xanthamonas orzyae* infection,
lesion length"
Citation: MOL GEN GENET (1999) 261: 58-63
Chromosome: 9
Flanking Markers(s):
QTL: ZM-ADCNLB-3-1
Species: *Zea mays*
General Trait: PATHOGEN RESISTANCE
Specific Trait: Area under disease progress
curve - northern leaf
blight
Citation: CROP SCI (1999) 39: 514-523
Chromosome: 3
Flanking Markers(s): "BNL8.01, UMC389B"
QTL: ZM-ADCNLB-3-2
Species: *Zea mays*
General Trait: PATHOGEN RESISTANCE
Specific Trait: Area under disease progress
curve - northern leaf
blight
Citation: CROP SCI (1999) 39: 514-523
Chromosome: 3
Flanking Markers(s): "UMC361, BNL15.20"
QTL: ZM-ADCNLB-5-1
Species: *Zea mays*
General Trait: PATHOGEN RESISTANCE
Specific Trait: Area under disease progress
curve - northern leaf
blight
Citation: CROP SCI (1999) 39: 514-523
Chromosome: 5
Flanking Markers(s): "UMC001, BNL5.40"
QTL: ZM-ADCNLB-5-2
Species: *Zea mays*
General Trait: PATHOGEN RESISTANCE
Specific Trait: Area under disease progress
curve - northern leaf
blight
Citation: CROP SCI (1999) 39: 514-523
Chromosome: 5
Flanking Markers(s): "BNL5.40, UMC051"
QTL: ZM-ADCNLB-5-3
Species: *Zea mays*
General Trait: PATHOGEN RESISTANCE
Specific Trait: Area under disease progress
curve - northern leaf
blight
Citation: CROP SCI (1999) 39: 514-523
Chromosome: 5
Flanking Markers(s): "UMC068, BNL5.24"
QTL: ZM-ADCNLB-9-1
Species: *Zea mays*
General Trait: PATHOGEN RESISTANCE
Specific Trait: Area under disease progress
curve - northern leaf
blight
Citation: CROP SCI (1999) 39: 514-523
Chromosome: 9
Flanking Markers(s): "UMC340, BNL7.57"
QTL: ZM-ANMT-1-1
Species: *Zea mays*
General Trait: PATHOGEN RESISTANCE
Specific Trait: "Area under the disease
progress curve, severity"
Citation: THEOR APPL GENET (1999)
99: 524-539
Chromosome: 1
Flanking Markers(s): "ASG30, CSU92"
QTL: ZM-ANMT-1-2
Species: *Zea mays*
General Trait: PATHOGEN RESISTANCE
Specific Trait: "Area under the disease
progress curve, severity"
Citation: THEOR APPL GENET (1999)
99: 540-553
Chromosome: 1
Flanking Markers(s): "ASG30, UMC177A"
QTL: ZM-ANMT-10-1
Species: *Zea mays*
General Trait: PATHOGEN RESISTANCE
Specific Trait: "Area under the disease
progress curve, severity"
Citation: THEOR APPL GENET (1999)
99: 524-539
Chromosome: 10
Flanking Markers(s): "NPI232A, UMC44A"
QTL: ZM-ANMT-10-2
Species: *Zea mays*
General Trait: PATHOGEN RESISTANCE
Specific Trait: "Area under the disease
progress curve, severity"
Citation: THEOR APPL GENET (1999)
99: 540-553
Chromosome: 10
Flanking Markers(s): "UMC44A, BNL7.49A"
QTL: ZM-ANMT-2-1
Species: *Zea mays*
General Trait: PATHOGEN RESISTANCE
Specific Trait: "Area under the disease
progress curve, severity"
Citation: THEOR APPL GENET (1999)
99: 524-539

TABLE 4-continued

Description of disease and pathogen resistance QTLs identified in Table 3.

Chromosome: 2
Flanking Markers(s): "UMC53A, UMC34"
QTL: ZM-ANMT-5-1
Species: *Zea mays*
General Trait: PATHOGEN RESISTANCE
Specific Trait: "Area under the disease progress curve, severity"
Citation: THEOR APPL GENET (1999) 99: 540-553
Chromosome: 5
Flanking Markers(s): "NPI409, UMC90"
QTL: ZM-ANMT-5-2
Species: *Zea mays*
General Trait: PATHOGEN RESISTANCE
Specific Trait: "Area under the disease progress curve, severity"
Citation: THEOR APPL GENET (1999) 99: 540-553
Chromosome: 5
Flanking Markers(s): "UMC166A, UMC1"
QTL: ZM-ANMT-8-1
Species: *Zea mays*
General Trait: PATHOGEN RESISTANCE
Specific Trait: "Area under the disease progress curve, severity"
Citation: THEOR APPL GENET (1999) 99: 540-553
Chromosome: 8
Flanking Markers(s): "CSU38B, UMC39B"
QTL: ZM-APIT-1-1
Species: *Zea mays*
General Trait: PATHOGEN RESISTANCE
Specific Trait: "Area under the disease progress curve, incidence"
Citation: THEOR APPL GENET (1999) 99: 524-539
Chromosome: 1
Flanking Markers(s): "ASG30, CSU92"
QTL: ZM-APIT-1-2
Species: *Zea mays*
General Trait: PATHOGEN RESISTANCE
Specific Trait: "Area under the disease progress curve, incidence"
Citation: THEOR APPL GENET (1999) 99: 540-553
Chromosome: 1
Flanking Markers(s): "ASG30, UMC177A"
QTL: ZM-APIT-10-1
Species: *Zea mays*
General Trait: PATHOGEN RESISTANCE
Specific Trait: "Area under the disease progress curve, incidence"
Citation: THEOR APPL GENET (1999) 99: 524-539
Chromosome: 10
Flanking Markers(s): "NPI232A, UMC44A"
QTL: ZM-APIT-10-2
Species: *Zea mays*
General Trait: PATHOGEN RESISTANCE
Specific Trait: "Area under the disease progress curve, incidence"
Citation: THEOR APPL GENET (1999) 99: 540-553
Chromosome: 10
Flanking Markers(s): "UMC44A, BNL7.49A"
QTL: ZM-APIT-2-1
Species: *Zea mays*
General Trait: PATHOGEN RESISTANCE
Specific Trait: "Area under the disease progress curve, incidence"
Citation: THEOR APPL GENET (1999) 99: 524-539
Chromosome: 2
Flanking Markers(s): CSU64
QTL: ZM-APIT-3-1
Species: *Zea mays*
General Trait: PATHOGEN RESISTANCE
Specific Trait: "Area under the disease progress curve, incidence"
Citation: THEOR APPL GENET (1999) 99: 524-539
Chromosome: 3
Flanking Markers(s): "UMC121, ASG48"
QTL: ZM-APIT-3-2
Species: *Zea mays*
General Trait: PATHOGEN RESISTANCE
Specific Trait: "Area under the disease progress curve, incidence"
Citation: THEOR APPL GENET (1999) 99: 540-553
Chromosome: 3
Flanking Markers(s): "UMC63A, UMC96"
QTL: ZM-APIT-6-1
Species: *Zea mays*
General Trait: PATHOGEN RESISTANCE
Specific Trait: "Area under the disease progress curve, incidence"
Citation: THEOR APPL GENET (1999) 99: 540-553
Chromosome: 6
Flanking Markers(s): "UMC137B, UMC28"
QTL: ZM-APIT-9-1
Species: *Zea mays*
General Trait: PATHOGEN RESISTANCE
Specific Trait: "Area under the disease progress curve, incidence"
Citation: THEOR APPL GENET (1999) 99: 524-539
Chromosome: 9
Flanking Markers(s): UMC113A
QTL: ZM-AUT-1-1
Species: *Zea mays*
General Trait: PATHOGEN RESISTANCE
Specific Trait: "Area under the disease progress curve, disease score"
Citation: THEOR APPL GENET (1999) 99: 524-539
Chromosome: 1
Flanking Markers(s): "ASG30, CSU92"
QTL: ZM-AUT-1-2
Species: *Zea mays*
General Trait: PATHOGEN RESISTANCE
Specific Trait: "Area under the disease progress curve, disease score"
Citation: THEOR APPL GENET (1999) 99: 540-553
Chromosome: 1
Flanking Markers(s): "ASG30, UMC177A"
QTL: ZM-AUT-10-1
Species: *Zea mays*
General Trait: PATHOGEN RESISTANCE
Specific Trait: "Area under the disease progress curve, disease score"
Citation: THEOR APPL GENET (1999) 99: 524-539
Chromosome: 10
Flanking Markers(s): "NPI232A, UMC44A"
QTL: ZM-AUT-10-2
Species: *Zea mays*
General Trait: PATHOGEN RESISTANCE
Specific Trait: "Area under the disease progress curve, disease score"
Citation: THEOR APPL GENET (1999) 99: 540-553
Chromosome: 10
Flanking Markers(s): "UMC44A, BNL7.49A"
QTL: ZM-AUT-2-1
Species: *Zea mays*
General Trait: PATHOGEN RESISTANCE
Specific Trait: "Area under the disease progress curve, disease score"
Citation: THEOR APPL GENET (1999)

TABLE 4-continued

Description of disease and pathogen resistance QTLs identified in Table 3.

99: 540-553
Chromosome: 2
Flanking Markers(s): "CSU6A, UMC8B"
QTL: ZM-AUT-3-1
Species: *Zea mays*
General Trait PATHOGEN RESISTANCE
Specific Trait: "Area under the disease
progress curve, disease score"
Citation: THEOR APPL GENET (1999)
99: 540-553
Chromosome: 3
Flanking Markers(s): "UMC63A, UMC96"
QTL: ZM-AUT-6-1
Species: *Zea mays*
General Trait: PATHOGEN RESISTANCE
Specific Trait: "Area under the disease
progress curve, disease score"
Citation: THEOR APPL GENET (1999)
99: 540-553
Chromosome: 6
Flanking Markers(s): "UMC137B, UMC28"
QTL: ZM-AUT-8-1
Species: *Zea mays*
General Trait: PATHOGEN RESISTANCE
Specific Trait: "Area under the disease
progress curve, disease score"
Citation: THEOR APPL GENET (1999)
99: 524-539
Chromosome: 8
Flanking Markers(s): "UMC30A, UMC71B"
QTL: ZM-CELW-5-1
Species: *Zea mays*
General Trait: PATHOGEN RESISTANCE
Specific Trait: Corn earworm larval weight
Citation: GENETICS (1998) 149: 1997-2006
Chromosome: 5
Flanking Markers(s): BNL5.71
QTL: ZM-CELW-6-1
Species: *Zea mays*
General Trait: PATHOGEN RESISTANCE
Specific Trait: Corn earworm larval weight
Citation: GENETICS (1998) 149: 1997-2006
Chromosome: 6
Flanking Markers(s): UMC85
QTL: ZM-CRR-1-10
Species: *Zea mays*
General Trait: PATHOGEN RESISTANCE
Specific Trait: Common rust rating
Citation: PHYTOPATHOLOGY (1998)
88: 1324-1329
Chromosome: 1
Flanking Markers(s): "UMC128, BNL15.18"
QTL: ZM-CRR-1-11
Species: *Zea mays*
General Trait: PATHOGEN RESISTANCE
Specific Trait: Common rust rating
Citation: PHYTOPATHOLOGY (1998)
88: 1324-1329
Chromosome: 1
Flanking Markers(s): "UMC167, UMC58"
QTL: ZM-CRR-1-12
Species: *Zea mays*
General Trait: PATHOGEN RESISTANCE
Specific Trait: Common rust rating
Citation: PHYTOPATHOLOGY (1998)
88: 1324-1329
Chromosome: 1
Flanking Markers(s): "UMC128, UMC83A"
QTL: ZM-CRR-1-13
Species: *Zea mays*
General Trait: PATHOGEN RESISTANCE
Specific Trait: Common rust rating
Citation: PHYTOPATHOLOGY (1998)
88: 1324-1329
Chromosome: 1
Flanking Markers(s): "UMC167, BNL5.59"
QTL: ZM-CRR-1-14
Species: *Zea mays*
General Trait: PATHOGEN RESISTANCE
Specific Trait: Common rust rating
Citation: THEOR APPL GENET (1999)
99: 593-598
Chromosome: 1
Flanking Markers(s): "BNL5.62A, UMC157"
QTL: ZM-CRR-1-15
Species: *Zea mays*
General Trait: PATHOGEN RESISTANCE
Specific Trait: Common rust rating
Citation: THEOR APPL GENET (1999)
99: 593-598
Chromosome: 1
Flanking Markers(s): CSU61B
QTL: ZM-CRR-1-16
Species: *Zea mays*
General Trait: PATHOGEN RESISTANCE
Specific Trait: Common rust rating
Citation: THEOR APPL GENET (1999)
99: 593-598
Chromosome: 1
Flanking Markers(s): UMC161A
QTL: ZM-CRR-10-4
Species: *Zea mays*
General Trait: PATHOGEN RESISTANCE
Specific Trait: Common rust rating
Citation: PHYTOPATHOLOGY (1998)
88: 1324-1329
Chromosome: 10
Flanking Markers(s): "UMC64, UMC44"
QTL: ZM-CRR-2-10
Species: *Zea mays*
General Trait: PATHOGEN RESISTANCE
Specific Trait: Common rust rating
Citation: PHYTOPATHOLOGY (1998)
88: 1324-1329
Chromosome: 2
Flanking Markers(s): "UMC131, UMC55"
QTL: ZM-CRR-2-11
Species: *Zea mays*
General Trait: PATHOGEN RESISTANCE
Specific Trait: Common rust rating
Citation: PHYTOPATHOLOGY (1998)
88: 1324-1329
Chromosome: 2
Flanking Markers(s): UMC36
QTL: ZM-CRR-2-9
Species: *Zea mays*
General Trait: PATHOGEN RESISTANCE
Specific Trait: Common rust rating
Citation: PHYTOPATHOLOGY (1998)
88: 1324-1329
Chromosome: 2
Flanking Markers(s): UMC131
QTL: ZM-CRR-3-6
Species: *Zea mays*
General Trait: PATHOGEN RESISTANCE
Specific Trait: Common rust rating
Citation: PHYTOPATHOLOGY (1998)
88: 1324-1329
Chromosome: 3
Flanking Markers(s): UMC175
QTL: ZM-CRR-3-7
Species: *Zea mays*
General Trait: PATHOGEN RESISTANCE
Specific Trait: Common rust rating
Citation: PHYTOPATHOLOGY (1998)
88: 1324-1329
Chromosome: 3
Flanking Markers(s): BNL1.297
QTL: ZM-CRR-3-8
Species: *Zea mays*
General Trait: PATHOGEN RESISTANCE
Specific Trait: Common rust rating

TABLE 4-continued

Description of disease and pathogen resistance QTLs identified in Table 3.

Citation: THEOR APPL GENET (1999)
99: 593-598
Chromosome: 3
Flanking Markers(s): "CSU285A, UMC3B"
QTL: ZM-CRR-3-9
Species: *Zea mays*
General Trait: PATHOGEN RESISTANCE
Specific Trait: Common rust rating
Citation: THEOR APPL GENET (1999)
99: 1106-1119
Chromosome: 3
Flanking Markers(s): "UMC3, UMC96"
QTL: ZM-CRR-4-3
Species: *Zea mays*
General Trait: PATHOGEN RESISTANCE
Specific Trait: Common rust rating
Citation: PHYTOPATHOLOGY (1998)
88: 1324-1329
Chromosome: 4
Flanking Markers(s): "UMC31, UMC127B"
QTL: ZM-CRR-4-4
Species: *Zea mays*
General Trait: PATHOGEN RESISTANCE
Specific Trait: Common rust rating
Citation: PHYTOPATHOLOGY (1998)
88: 1324-1329
Chromosome: 4
Flanking Markers(s): "UMC31, UMC47"
QTL: ZM-CRR-4-5
Species: *Zea mays*
General Trait: PATHOGEN RESISTANCE
Specific Trait: Common rust rating
Citation: PHYTOPATHOLOGY (1998)
88: 1324-1329
Chromosome: 4
Flanking Markers(s): "BNL7.65, UMC52"
QTL: ZM-CRR-4-6
Species: *Zea mays*
General Trait: PATHOGEN RESISTANCE
Specific Trait: Common rust rating
Citation: THEOR APPL GENET (1999)
99: 1106-1119
Chromosome: 4
Flanking Markers(s): UMC47
QTL: ZM-CRR-5-6
Species: *Zea mays*
General Trait: PATHOGEN RESISTANCE
Specific Trait: Common rust rating
Citation: PHYTOPATHOLOGY (1998)
88: 1324-1329
Chromosome: 5
Flanking Markers(s): BNL6.25
QTL: ZM-CRR-5-7
Species: *Zea mays*
General Trait: PATHOGEN RESISTANCE
Specific Trait: Common rust rating
Citation: PHYTOPATHOLOGY (1998)
88: 1324-1329
Chromosome: 5
Flanking Markers(s): "BNL7.71, BNL5.40"
QTL: ZM-CRR-5-9
Species: *Zea mays*
General Trait: PATHOGEN RESISTANCE
Specific Trait: Common rust rating
Citation: THEOR APPL GENET (1999)
99: 593-598
Chromosome: 5
Flanking Markers(s): BNL7.71
QTL: ZM-CRR-6-4
Species: *Zea mays*
General Trait: PATHOGEN RESISTANCE
Specific Trait: Common rust rating
Citation: PHYTOPATHOLOGY (1998)
88: 1324-1329
Chromosome: 6
Flanking Markers(s): UMC132
QTL: ZM-CRR-6-5
Species: *Zea mays*
General Trait: PATHOGEN RESISTANCE
Specific Trait: Common rust rating
Citation: PHYTOPATHOLOGY (1998)
88: 1324-1329
Chromosome: 6
Flanking Markers(s): "UMC65, UMC21"
QTL: ZM-CRR-6-6
Species: *Zea mays*
General Trait: PATHOGEN RESISTANCE
Specific Trait: Common rust rating
Citation: THEOR APPL GENET (1999)
99: 593-598
Chromosome: 6
Flanking Markers(s): UMC65A
QTL: ZM-CRR-7-5
Species: *Zea mays*
General Trait: PATHOGEN RESISTANCE
Specific Trait: Common rust rating
Citation: PHYTOPATHOLOGY (1998)
88: 1324-1329
Chromosome: 7
Flanking Markers(s): "H135, UMC98B"
QTL: ZM-CRR-7-6
Species: *Zea mays*
General Trait: PATHOGEN RESISTANCE
Specific Trait: Common rust rating
Citation: PHYTOPATHOLOGY (1998)
88: 1324-1329
Chromosome: 7
Flanking Markers(s): "NPI443B, BNL15.21"
QTL: ZM-CRR-8-6
Species: *Zea mays*
General Trait: PATHOGEN RESISTANCE
Specific Trait: Common rust rating
Citation: PHYTOPATHOLOGY (1998)
88: 1324-1329
Chromosome: 8
Flanking Markers(s): "BNL9.11, UMC12A"
QTL: ZM-CRR-8-7
Species: *Zea mays*
General Trait: PATHOGEN RESISTANCE
Specific Trait: Common rust rating
Citation: PHYTOPATHOLOGY (1998)
88: 1324-1329
Chromosome: 8
Flanking Markers(s): "UMC103, UMC12A"
QTL: ZM-CRR-9-2
Species: *Zea mays*
General Trait: PATHOGEN RESISTANCE
Specific Trait: Common rust rating
Citation: PHYTOPATHOLOGY (1998)
88: 1324-1329
Chromosome: 9
Flanking Markers(s): BNL14.28
QTL: ZM-CRR-9-3
Species: *Zea mays*
General Trait: PATHOGEN RESISTANCE
Specific Trait: Common rust rating
Citation: PHYTOPATHOLOGY (1998)
88: 1324-1329
Chromosome: 9
Flanking Markers(s): BNL5.09
QTL: ZM-CRR-9-4
Species: *Zea mays*
General Trait: PATHOGEN RESISTANCE
Specific Trait: Common rust rating
Citation: PHYTOPATHOLOGY (1998)
88: 1324-1329
Chromosome: 9
Flanking Markers(s): UMC109
QTL: ZM-CRR-9-5
Species: *Zea mays*
General Trait: PATHOGEN RESISTANCE
Specific Trait: Common rust rating

TABLE 4-continued

Description of disease and pathogen resistance QTLs identified in Table 3.

Citation: THEOR APPL GENET (1999)
99: 1106-1119
Chromosome: 9
Flanking Markers(s): "UMC153, BNL5.09"
QTL: ZM-CSVEG-1-1
Species: *Zea mays*
General Trait: PATHOGEN RESISTANCE
Specific Trait: "Common smut infection,
percentage of plants with
visible ear galls"
Citation: THEOR APPL GENET (1998)
97: 1321-1330
Chromosome: 1
Flanking Markers(s): "UMC83, BNL15.18"
QTL: ZM-CSVEG-10-1
Species: *Zea mays*
General Trait: PATHOGEN RESISTANCE
Specific Trait: "Common smut infection,
percentage of plants with
visible ear galls"
Citation: THEOR APPL GENET (1998)
97: 1321-1330
Chromosome: 10
Flanking Markers(s): "UMC64, UMC146"
QTL: ZM-CSVEG-2-1
Species: *Zea mays*
General Trait: PATHOGEN RESISTANCE
Specific Trait: "Common smut infection,
percentage of plants with
visible ear galls"
Citation: THEOR APPL GENET (1998)
97: 1321-1330
Chromosome: 2
Flanking Markers(s): "UMC34, UMC163"
QTL: ZM-CSVEG-4-1
Species: *Zea mays*
General Trait: PATHOGEN RESISTANCE
Specific Trait: "Common smut infection,
percentage of plants with
visible ear galls"
Citation: THEOR APPL GENET (1998)
97: 1321-1330
Chromosome: 4
Flanking Markers(s): "UMC31, UMC42"
QTL: ZM-CSVEG-4-2
Species: *Zea mays*
General Trait: PATHOGEN RESISTANCE
Specific Trait: "Common smut infection,
percentage of plants with
visible ear galls"
Citation: THEOR APPL GENET (1998)
97: 1321-1330
Chromosome: 4
Flanking Markers(s): "UMC52, BNL15.07"
QTL: ZM-CSVEG-7-1
Species: *Zea mays*
General Trait: PATHOGEN RESISTANCE
Specific Trait: "Common smut infection,
percentage of plants with
visible ear galls"
Citation: THEOR APPL GENET (1998)
97: 1321-1330
Chromosome: 7
Flanking Markers(s): "UMC80, UMC35"
QTL: ZM-CSVEG-9-1
Species: *Zea mays*
General Trait: PATHOGEN RESISTANCE
Specific Trait: "Common smut infection,
percentage of plants with
visible ear galls"
Citation: THEOR APPL GENET (1998)
97: 1321-1330
Chromosome: 9
Flanking Markers(s): "BNL5.09, NPI291"
QTL: ZM-CSVSG-1-1
Species: *Zea mays*
General Trait: PATHOGEN RESISTANCE
Specific Trait: "Common smut infection,
percentage of plants with
visible stem galls"
Citation: THEOR APPL GENET (1998)
97: 1321-1330
Chromosome: 1
Flanking Markers(s): "UMC137, UMC13"
QTL: ZM-CSVSG-2-1
Species: *Zea mays*
General Trait: PATHOGEN RESISTANCE
Specific Trait: "Common smut infection,
percentage of plants with
visible stem galls"
Citation: THEOR APPL GENET (1998)
97: 1321-1330
Chromosome: 2
Flanking Markers(s): "UMC34, UMC163"
QTL: ZM-CSVSG-4-1
Species: *Zea mays*
General Trait: PATHOGEN RESISTANCE
Specific Trait: "Common smut infection,
percentage of plants with
visible stem galls"
Citation: THEOR APPL GENET (1998)
97: 1321-1330
Chromosome: 4
Flanking Markers(s): "UMC52, BNL15.07"
QTL: ZM-DMS-1-1
Species: *Zea mays*
General Trait: PATHOGEN RESISTANCE
Specific Trait: Downy mildew susceptibility
Citation: THEOR APPL GENET (1999)
99: 519-523
Chromosome: 1
Flanking Markers(s): UMC11
QTL: ZM-DMS-1-2
Species: *Zea mays*
General Trait: PATHOGEN RESISTANCE
Specific Trait: Downy mildew susceptibility
Citation: THEOR APPL GENET (1999)
99: 519-523
Chromosome: 1
Flanking Markers(s): UMC23A
QTL: ZM-DMS-9-1
Species: *Zea mays*
General Trait: PATHOGEN RESISTANCE
Specific Trait: Downy mildew susceptibility
Citation: THEOR APPL GENET (1999)
99: 519-523
Chromosome: 9
Flanking Markers(s): UMC113
QTL: ZM-ECB-2-1
Species: *Zea mays*
General Trait: PATHOGEN RESISTANCE
Specific Trait: European corn borer stalk
tunneling
Citation: CROP SCI (2001) 41: 835-845
Chromosome: 2
Flanking Markers(s):
QTL: ZM-ECB-2-2
Species: *Zea mays*
General Trait: PATHOGEN RESISTANCE
Specific Trait: European corn borer stalk
tunneling
Citation: CROP SCI (2001) 41: 835-845
Chromosome: 2
Flanking Markers(s):
QTL: ZM-ECB-5-1
Species: *Zea mays*
General Trait: PATHOGEN RESISTANCE
Specific Trait: European corn borer stalk
tunneling
Citation: CROP SCI (2001) 41: 835-845
Chromosome: 5
Flanking Markers(s):

TABLE 4-continued

Description of disease and pathogen resistance QTLs identified in Table 3.

QTL: ZM-ECB-7-1
Species: Zea mays
General Trait: PATHOGEN RESISTANCE
Specific Trait: European corn borer stalk tunneling
Citation: CROP SCI (2001) 41: 835-845
Chromosome: 7
Flanking Markers(s):
QTL: ZM-ECB-8-1
Species: Zea mays
General Trait: PATHOGEN RESISTANCE
Specific Trait: European corn borer stalk tunneling
Citation: CROP SCI (2001) 41: 835-845
Chromosome: 8
Flanking Markers(s):
QTL: ZM-ECB-9-1
Species: Zea mays
General Trait: PATHOGEN RESISTANCE
Specific Trait: European corn borer stalk tunneling
Citation: CROP SCI (2001) 41: 835-845
Chromosome: 9
Flanking Markers(s):
QTL: ZM-ECB-9-2
Species: Zea mays
General Trait: PATHOGEN RESISTANCE
Specific Trait: European corn borer stalk tunneling
Citation: CROP SCI (2001) 41: 835-845
Chromosome: 9
Flanking Markers(s):
QTL: ZM-ETURI-2-1
Species: Zea mays
General Trait: PATHOGEN RESISTANCE
Specific Trait: "E. turcicum infection, foliar disease score"
Citation: THEOR APPL GENET (1999) 99: 1106-1119
Chromosome: 2
Flanking Markers(s): UMC6
QTL: ZM-ETURI-5-1
Species: Zea mays
General Trait: PATHOGEN RESISTANCE
Specific Trait: "E. turcicum infection, foliar disease score"
Citation: THEOR APPL GENET (1999) 99: 1106-1119
Chromosome: 5
Flanking Markers(s): UMC51
QTL: ZM-GLS-1-1
Species: Zea mays
General Trait: PATHOGEN RESISTANCE
Specific Trait: Susceptibility to gray leaf spot
Citation: PHYTOPATHOLOGY (2000) 90: 1018-1025
Chromosome: 1
Flanking Markers(s):
QTL: ZM-GLS-2-1
Species: Zea mays
General Trait: PATHOGEN RESISTANCE
Specific Trait: Susceptibility to gray leaf spot
Citation: PHYTOPATHOLOGY (2000) 90: 1018-1025
Chromosome: 2
Flanking Markers(s):
QTL: ZM-GLS-3-1
Species: Zea mays
General Trait: PATHOGEN RESISTANCE
Specific Trait: Susceptibility to gray leaf spot
Citation: PHYTOPATHOLOGY (2000) 90: 1018-1025
Chromosome: 3
Flanking Markers(s):
QTL: ZM-GLS-3-2
Species: Zea mays
General Trait: PATHOGEN RESISTANCE
Specific Trait: Susceptibility to gray leaf spot
Citation: PHYTOPATHOLOGY (2000) 90: 1018-1025
Chromosome: 3
Flanking Markers(s):
QTL: ZM-GLS-4-1
Species: Zea mays
General Trait: PATHOGEN RESISTANCE
Specific Trait: Susceptibility to gray leaf spot
Citation: PHYTOPATHOLOGY (2000) 90: 1018-1025
Chromosome: 4
Flanking Markers(s):
QTL: ZM-GLS-5-1
Species: Zea mays
General Trait: PATHOGEN RESISTANCE
Specific Trait: Susceptibility to gray leaf spot
Citation: PHYTOPATHOLOGY (2000) 90: 1018-1025
Chromosome: 5
Flanking Markers(s):
QTL: ZM-GLS-5-2
Species: Zea mays
General Trait: PATHOGEN RESISTANCE
Specific Trait: Susceptibility to gray leaf spot
Citation: PHYTOPATHOLOGY (2000) 90: 1018-1025
Chromosome: 5
Flanking Markers(s):
QTL: ZM-GLS-6-1
Species: Zea mays
General Trait: PATHOGEN RESISTANCE
Specific Trait: Susceptibility to gray leaf spot
Citation: PHYTOPATHOLOGY (2000) 90: 1018-1025
Chromosome: 6
Flanking Markers(s):
QTL: ZM-GLS-7-1
Species: Zea mays
General Trait: PATHOGEN RESISTANCE
Specific Trait: Susceptibility to gray leaf spot
Citation: PHYTOPATHOLOGY (2000) 90: 1018-1025
Chromosome: 7
Flanking Markers(s):
QTL: ZM-GLS-7-2
Species: Zea mays
General Trait: PATHOGEN RESISTANCE
Specific Trait: Susceptibility to gray leaf spot
Citation: PHYTOPATHOLOGY (2000) 90: 1018-1025
Chromosome: 7
Flanking Markers(s):
QTL: ZM-GLS-8-1
Species: Zea mays
General Trait: PATHOGEN RESISTANCE
Specific Trait: Susceptibility to gray leaf spot
Citation: PHYTOPATHOLOGY (2000) 90: 1018-1025
Chromosome: 8
Flanking Markers(s):
QTL: ZM-HMAYI-3-1
Species: Zea mays
General Trait: PATHOGEN RESISTANCE
Specific Trait: "H. maydis infection, foliar disease score"
Citation: THEOR APPL GENET (1999) 99: 1106-1119
Chromosome: 3
Flanking Markers(s): "UMC121, BNL8.35A"
QTL: ZM-HPVI-3-1
Species: Zea mays
General Trait: PATHOGEN RESISTANCE
Specific Trait: High plains virus infection
Citation: CROP SCI (1999) 39: 1171-1177

TABLE 4-continued

Description of disease and pathogen resistance QTLs identified in Table 3.

Chromosome: 3
Flanking Markers(s): ASG48
QTL: ZM-HPVI-6-1
Species: *Zea mays*
General Trait: PATHOGEN RESISTANCE
Specific Trait: High plains virus infection
Citation: CROP SCI (1999) 39: 1171-1177
Chromosome: 6
Flanking Markers(s): UMC85A
QTL: ZM-LT-1-1
Species: *Zea mays*
General Trait: PATHOGEN RESISTANCE
Specific Trait: Leaf toughness
Citation: CROP SCI (1998) 38: 1062-1072
Chromosome: 1
Flanking Markers(s):
"CSU92, CSUCMT11B"
QTL: ZM-LT-1-2
Species: *Zea mays*
General Trait: PATHOGEN RESISTANCE
Specific Trait: Leaf toughness
Citation: CROP SCI (1998) 38: 1062-1072
Chromosome: 1
Flanking Markers(s): "UMC83A, UMC49D"
QTL: ZM-LT-4-1
Species: *Zea mays*
General Trait: PATHOGEN RESISTANCE
Specific Trait: Leaf toughness
Citation: CROP SCI (1998) 38: 1062-1072
Chromosome: 4
Flanking Markers(s): "UMC31A, UMC49D"
QTL: ZM-LT-5-1
Species: *Zea mays*
General Trait: PATHOGEN RESISTANCE
Specific Trait: Leaf toughness
Citation: CROP SCI (1998) 38: 1062-1072
Chromosome: 5
Flanking Markers(s): "UMC126A, UMC51A"
QTL: ZM-LT-7-1
Species: *Zea mays*
General Trait: PATHOGEN RESISTANCE
Specific Trait: Leaf toughness
Citation: CROP SCI (1998) 38: 1062-1072
Chromosome: 7
Flanking Markers(s): "BNL14.07, UMC151"
QTL: ZM-LT-8-1
Species: *Zea mays*
General Trait: PATHOGEN RESISTANCE
Specific Trait: Leaf toughness
Citation: CROP SCI (1998) 38: 1062-1072
Chromosome: 8
Flanking Markers(s): "UMC150A, CSU38B"
QTL: ZM-LT-8-2
Species: *Zea mays*
General Trait: PATHOGEN RESISTANCE
Specific Trait: Leaf toughness
Citation: CROP SCI (1998) 38: 1062-1072
Chromosome: 8
Flanking Markers(s):
"UMC150A, CSU165A"
QTL: ZM-LVI-4-1
Species: *Zea mays*
General Trait: PATHOGEN RESISTANCE
Specific Trait: Localized virus infection
Citation: CROP SCI (1999) 39: 1171-1177
Chromosome: 4
Flanking Markers(s): UMC66A
QTL: ZM-LVI-5-1
Species: *Zea mays*
General Trait: PATHOGEN RESISTANCE
Specific Trait: Localized virus infection
Citation: CROP SCI (1999) 39: 1171-1177
Chromosome: 5
Flanking Markers(s): BNL5.40
QTL: ZM-LVI-6-1
Species: *Zea mays*
General Trait: PATHOGEN RESISTANCE
Specific Trait: Localized virus infection
Citation: CROP SCI (1999) 39: 1171-1177
Chromosome: 6
Flanking Markers(s): UMC85A
QTL: ZM-MSVI-1-1
Species: *Zea mays*
General Trait: PATHOGEN RESISTANCE
Specific Trait: Maize streak virus infection
Citation: THEOR APPL GENET (1999) 99: 524-539
Chromosome: 1
Flanking Markers(s): "ASG30, CSU92"
QTL: ZM-MSVI-1-2
Species: *Zea mays*
General Trait: PATHOGEN RESISTANCE
Specific Trait: Maize streak virus infection
Citation: THEOR APPL GENET (1999) 99: 524-539
Chromosome: 1
Flanking Markers(s): UMC66B
QTL: ZM-MSVI-10-1
Species: *Zea mays*
General Trait: PATHOGEN RESISTANCE
Specific Trait: Maize streak virus infection
Citation: THEOR APPL GENET (1999) 99: 524-539
Chromosome: 10
Flanking Markers(s): "NP1232A, UMC44A"
QTL: ZM-MSVI-2-1
Species: *Zea mays*
General Trait: PATHOGEN RESISTANCE
Specific Trait: Maize streak virus infection
Citation: THEOR APPL GENET (1999) 99: 524-539
Chromosome: 2
Flanking Markers(s): "UMC53A, UMC34"
QTL: ZM-MSVI-2-2
Species: *Zea mays*
General Trait: PATHOGEN RESISTANCE
Specific Trait: Maize streak virus infection
Citation: THEOR APPL GENET (1999) 99: 524-539
Chromosome: 2
Flanking Markers(s): UMC131
QTL: ZM-MSVI-3-1
Species: *Zea mays*
General Trait: PATHOGEN RESISTANCE
Specific Trait: Maize streak virus infection
Citation: THEOR APPL GENET (1999) 99: 524-539
Chromosome: 3
Flanking Markers(s): "UMC96, CSU25A"
QTL: ZM-MSVI-3-2
Species: *Zea mays*
General Trait: PATHOGEN RESISTANCE
Specific Trait: Maize streak virus infection
Citation: THEOR APPL GENET (1999) 99: 524-539
Chromosome: 3
Flanking Markers(s): "UMC121, ASG48"
QTL: ZM-MSVI-8-1
Species: *Zea mays*
General Trait: PATHOGEN RESISTANCE
Specific Trait: Maize streak virus infection
Citation: THEOR APPL GENET (1999) 99: 524-539
Chromosome: 8
Flanking Markers(s): "UMC30A, UMC71B"
QTL: ZM-MSVI-9-1
Species: *Zes mays*
General Trait: PATHOGEN RESISTANCE
Specific Trait: Maize streak virus infection
Citation: THEOR APPL GENET (1999) 99: 524-539
Chromosome: 9

TABLE 4-continued

Description of disease and pathogen resistance QTLs identified in Table 3.

Flanking Markers(s): UMC113A
QTL: ZM-NLBDS-1-1
Species: *Zea mays*
General Trait: PATHOGEN RESISTANCE
Specific Trait: "Northern corn leaf blight, disease severity"
Citation: THEOR APPL GENET (1999) 99: 649-655
Chromosome: 1
Flanking Markers(s): "CSU61B, DUP12"
QTL: ZM-NLBDS-10-2
Species: *Zea mays*
General Trait: PATHOGEN RESISTANCE
Specific Trait: "Northern corn leaf blight, disease severity"
Citation: THEOR APPL GENET (1999) 98: 1036-1045
Chromosome: 10
Flanking Markers(s): "NPI264, UMC130"
QTL: ZM-NLBDS-2-3
Species: *Zea mays*
General Trait: PATHOGEN RESISTANCE
Specific Trait: "Northern corn leaf blight, disease severity"
Citation: THEOR APPL GENET (1999) 99: 649-655
Chromosome: 2
Flanking Markers(s): "UMC255A, UMC5A"
QTL: ZM-NLBDS-3-2
Species: *Zea mays*
General Trait: PATHOGEN RESISTANCE
Specific Trait: "Northern corn leaf blight, disease severity"
Citation: THEOR APPL GENET (1999) 98: 1036-1045
Chromosome: 3
Flanking Markers(s): "UMC361, BNL15.20"
QTL: ZM-NLBDS-3-5
Species: *Zea mays*
General Trait: PATHOGEN RESISTANCE
Specific Trait: "Northern corn leaf blight, disease severity"
Citation: THEOR APPL GENET (1999) 99: 649-655
Chromosome: 3
Flanking Markers(s): "UMC3B, UMC17A"
QTL: ZM-NLBDS-4-1
Species: *Zea mays*
General Trait: PATHOGEN RESISTANCE
Specific Trait: "Northern corn leaf blight, disease severity"
Citation: THEOR APPL GENET (1999) 99: 649-655
Chromosome: 4
Flanking Markers(s): "PHI021, CSU253B"
QTL: ZM-NLBDS-4-2
Species: *Zea mays*
General Trait: PATHOGEN RESISTANCE
Specific Trait: "Northern corn leaf blight, disease severity"
Citation: THEOR APPL GENET (1999) 99: 649-655
Chromosome: 4
Flanking Markers(s): "UMC47, UMC66A"
QTL: ZM-NLBDS-5-1
Species: *Zea mays*
General Trait: PATHOGEN RESISTANCE
Specific Trait: "Northern corn leaf blight, disease severity"
Citation: THEOR APPL GENET (1999) 98: 1036-1045
Chromosome: 5
Flanking Markers(s): "UMC001, BNL5.40"
QTL: ZM-NLBDS-5-2
Species: *Zea mays*
General Trait: PATHOGEN RESISTANCE
Specific Trait: "Northern corn leaf blight, disease severity"
Citation: THEOR APPL GENET (1999) 98: 1036-1045
Chromosome: 5
Flanking Markers(s): "BNL5.40, NPI461"
QTL: ZM-NLBDS-5-3
Species: *Zea mays*
General Trait: PATHOGEN RESISTANCE
Specific Trait: "Northern corn leaf blight, disease severity"
Citation: THEOR APPL GENET (1999) 98: 1036-1045
Chromosome: 5
Flanking Markers(s): "UMC068, BNL5.24"
QTL: ZM-NLBDS-5-4
Species: *Zea mays*
General Trait: PATHOGEN RESISTANCE
Specific Trait: "Northern corn leaf blight, disease severity"
Citation: THEOR APPL GENET (1999) 99: 649-655
Chromosome: 5
Flanking Markers(s): "UMC27A, UMC43"
QTL: ZM-NLBDS-5-5
Species: *Zea mays*
General Trait: PATHOGEN RESISTANCE
Specific Trait: "Northern corn leaf blight, disease severity"
Citation: THEOR APPL GENET (1999) 99: 649-655
Chromosome: 5
Flanking Markers(s): "CSU36A, BNL7.71"
QTL: ZM-NLBDS-6-1
Species: *Zea mays*
General Trait: PATHOGEN RESISTANCE
Specific Trait: "Northern corn leaf blight, disease severity"
Citation: THEOR APPL GENET (1999) 99: 649-655
Chromosome: 6
Flanking Markers(s): "UMC21, ASG7"
QTL: ZM-NLBDS-8-1
Species: *Zea mays*
General Trait: PATHOGEN RESISTANCE
Specific Trait: "Northern corn leaf blight, disease severity"
Citation: THEOR APPL GENET (1999) 98: 1036-1045
Chromosome: 8
Flanking Markers(s): "BNL12.30, UMC030"
QTL: ZM-NLBDS-8-2
Species: *Zea mays*
General Trait: PATHOGEN RESISTANCE
Specific Trait: "Northern corn leaf blight, disease severity"
Citation: THEOR APPL GENET (1999) 99: 649-655
Chromosome: 8
Flanking Markers(s): "UMC103A, BNGL669"
QTL: ZM-NLBDS-8-3
Species: *Zea mays*
General Trait: PATHOGEN RESISTANCE
Specific Trait: "Northern corn leaf blight, disease severity"
Citation: THEOR APPL GENET (1999) 99: 649-655
Chromosome: 8
Flanking Markers(s): "UMC17B, NPI268A"
QTL: ZM-NLBDS-9-1
Species: *Zea mays*
General Trait: PATHOGEN RESISTANCE
Specific Trait: "Northern corn leaf blight, disease severity"
Citation: THEOR APPL GENET (1999)

TABLE 4-continued

Description of disease and pathogen resistance QTLs identified in Table 3.

98: 1036-1045
Chromosome: 9
Flanking Markers(s): "UMC380, BNL7.57"
QTL: ZM-NLBDS-9-2
Species: *Zea mays*
General Trait: PATHOGEN RESISTANCE
Specific Trait: "Northern corn leaf blight, disease severity"
Citation: THEOR APPL GENET (1999) 99: 649-655
Chromosome: 9
Flanking Markers(s): "UMC105A, UMC114"
QTL: ZM-NLBIP-3-1
Species: *Zea mays*
General Trait: PATHOGEN RESISTANCE
Specific Trait: "Northern corn leaf blight, incubation period"
Citation: CROP SCI (1999) 39: 514-523
Chromosome: 3
Flanking Markers(s): "BNL8.01, UMC389B"
QTL: ZM-NLBIP-4-1
Species: *Zea mays*
General Trait: PATHOGEN RESISTANCE
Specific Trait: "Northern corn leaf blight, incubation period"
Citation: CROP SCI (1999) 39: 514-523
Chromosome: 4
Flanking Markers(s): "BNL15.45, UMC362"
QTL: ZM-NLBIP-5-1
Species: *Zea mays*
General Trait: PATHOGEN RESISTANCE
Specific Trait: "Northern corn leaf blight, incubation period"
Citation: CROP SCI (1999) 39: 514-523
Chromosome: 5
Flanking Markers(s): "UMC001, BNL5.40"
QTL: ZM-NLBIP-8-1
Species: *Zea mays*
General Trait: PATHOGEN RESISTANCE
Specific Trait: "Northern corn leaf blight, incubation period"
Citation: CROP SCI (1999) 39: 514-523
Chromosome: 8
Flanking Markers(s): "BNL12.30, UMC323"
QTL: ZM-NLBIP-9-1
Species: *Zea mays*
General Trait: PATHOGEN RESISTANCE
Specific Trait: "Northern corn leaf blight, incubation period"
Citation: CROP SCI (1999) 39: 514-523
Chromosome: 9
Flanking Markers(s): "UMC340, BNL7.57"
QTL: ZM-PCSI-1-1
Species: *Zea mays*
General Trait: PATHOGEN RESISTANCE
Specific Trait: "Common smut infection, percentage of plants infected"
Citation: THEOR APPL GENET (1998) 97: 1321-1330
Chromosome: 1
Flanking Markers(s): "BNL8.05, UMC76"
QTL: ZM-PCSI-1-2
Species: *Zea mays*
General Trait: PATHOGEN RESISTANCE
Specific Trait: "Common smut infection, percentage of plants infected"
Citation: THEOR APPL GENET (1998) 97: 1321-1330
Chromosome: 1
Flanking Markers(s): "BNL7.21, BNL5.59"
QTL: ZM-PCSI-1-3
Species: *Zea mays*
General Trait: PATHOGEN RESISTANCE
Specific Trait: "Common smut infection, percentage of plants infected"
Citation: THEOR APPL GENET (1998) 97: 1321-1330
Chromosome: 1
Flanking Markers(s): UMC167
QTL: ZM-PCSI-1-4
Species: *Zea mays*
General Trait: PATHOGEN RESISTANCE
Specific Trait: "Common smut infection, percentage of plants infected"
Citation: THEOR APPL GENET (1998) 97: 1321-1330
Chromosome: 1
Flanking Markers(s): "UMC83A, BNL8.29"
QTL: ZM-PCSI-1-5
Species: *Zea mays*
General Trait: PATHOGEN RESISTANCE
Specific Trait: "Common smut infection, percentage of plants infected"
Citation: THEOR APPL GENET (1998) 97: 1321-1330
Chromosome: 1
Flanking Markers(s): "UMC13, UMC167"
QTL: ZM-PCSI-1-6
Species: *Zea mays*
General Trait: PATHOGEN RESISTANCE
Specific Trait: "Common smut infection, percentage of plants infected"
Citation: THEOR APPL GENET (1998) 97: 1321-1330
Chromosome: 1
Flanking Markers(s): "UMC83, BNL15.18"
QTL: ZM-PCSI-1-7
Species: *Zea mays*
General Trait: PATHOGEN RESISTANCE
Specific Trait: "Common smut infection, percentage of plants infected"
Citation: THEOR APPL GENET (1999) 99: 593-598
Chromosome: 1
Flanking Markers(s): UMC58
QTL: ZM-PCSI-10-1
Species: *Zea mays*
General Trait: PATHOGEN RESISTANCE
Specific Trait: "Common smut infection, percentage of plants infected"
Citation: THEOR APPL GENET (1998) 97: 1321-1330
Chromosome: 10
Flanking Markers(s): UMC146
QTL: ZM-PCSI-10-2
Species: *Zea mays*
General Trait: PATHOGEN RESISTANCE
Specific Trait: "Common smut infection, percentage of plants infected"
Citation: THEOR APPL GENET (1998) 97: 1321-1330
Chromosome: 10
Flanking Markers(s): "UMC64, UMC146"
QTL: ZM-PCSI-2-1
Species: *Zea mays*
General Trait: PATHOGEN RESISTANCE
Specific Trait: "Common smut infection, percentage of plants infected"
Citation: THEOR APPL GENET (1998) 97: 1321-1330
Chromosome: 2
Flanking Markers(s): "UMC6, UMC34"
QTL: ZM-PCSI-2-2
Species: *Zea mays*
General Trait: PATHOGEN RESISTANCE
Specific Trait: "Common smut infection, percentage of plants infected"
Citation: THEOR APPL GENET (1998) 97: 1321-1330
Chromosome: 2
Flanking Markers(s): "UMC131, UMC5"
QTL: ZM-PCSI-2-3

TABLE 4-continued

Description of disease and pathogen resistance QTLs identified in Table 3.

Species: *Zea mays*
General Trait: PATHOGEN RESISTANCE
Specific Trait: "Common smut infection, percentage of plants infected"
Citation: THEOR APPL GENET (1998) 97: 1321-1330
Chromosome: 2
Flanking Markers(s): UMC55
QTL: ZM-PCSI-2-4
Species: *Zea mays*
General Trait: PATHOGEN RESISTANCE
Specific Trait: "Common smut infection, percentage of plants infected"
Citation: THEOR APPL GENET (1998) 97: 1321-1330
Chromosome: 2
Flanking Markers(s): UMC4
QTL: ZM-PCSI-2-5
Species: *Zea mays*
General Trait: PATHOGEN RESISTANCE
Specific Trait: "Common smut infection, percentage of plants infected"
Citation: THEOR APPL GENET (1998) 97: 1321-1330
Chromosome: 2
Flanking Markers(s): "UMC34, UMC163"
QTL: ZM-PCSI-2-7
Species: *Zea mays*
General Trait: PATHOGEN RESISTANCE
Specific Trait: "Common smut infection, percentage of plants infected"
Citation: THEOR APPL GENET (1999) 99: 593-598
Chromosome: 2
Flanking Markers(s): "UMC131, UMC255A"
QTL: ZM-PCSI-2-9
Species: *Zea mays*
General Trait: PATHOGEN RESISTANCE
Specific Trait: "Common smut infection, percentage of plants infected"
Citation: THEOR APPL GENET (1999) 99: 593-598
Chromosome: 2
Flanking Markers(s): UMC34
QTL: ZM-PCSI-3-1
Species: *Zea mays*
General Trait: PATHOGEN RESISTANCE
Specific Trait: "Common smut infection, percentage of plants infected"
Citation: THEOR APPL GENET (1998) 97: 1321-1330
Chromosome: 3
Flanking Markers(s): "UMC102, UMC26"
QTL: ZM-PCSI-3-2
Species: *Zea mays*
General Trait: PATHOGEN RESISTANCE
Specific Trait: "Common smut infection, percentage of plants infected"
Citation: THEOR APPL GENET (1998) 97: 1321-1330
Chromosome: 3
Flanking Markers(s): UMC60
QTL: ZM-PCSI-3-3
Species: *Zen mays*
General Trait: PATHOGEN RESISTANCE
Specific Trait: "Common smut infection, percentage of plants infected"
Citation: THEOR APPL GENET (1998) 97: 1321-1330
Chromosome: 3
Flanking Markers(s): UMC16
QTL: ZM-PCSI-3-4
Species: *Zen mays*
General Trait: PATHOGEN RESISTANCE
Specific Trait: "Common smut infection, percentage of plants infected"
Citation: THEOR APPL GENET (1998) 97: 1321-1330
Chromosome: 3
Flanking Markers(s): "UMC3, UMC96"
QTL: ZM-PCSI-3-5
Species: *Zea mays*
General Trait: PATHOGEN RESISTANCE
Specific Trait: "Common smut infection, percentage of plants infected"
Citation: THEOR APPL GENET (1998) 97: 1321-1330
Chromosome: 3
Flanking Markers(s): "UMC60, BNL15.20"
QTL: ZM-PCSI-3-6
Species: *Zea mays*
General Trait: PATHOGEN RESISTANCE
Specific Trait: "Common smut infection, percentage of plants infected"
Citation: THEOR APPL GENET (1999) 99: 593-598
Chromosome: 3
Flanking Markers(s): "UMC102, CSU285B"
QTL: ZM-PCSI-4-1
Species: *Zea mays*
General Trait: PATHOGEN RESISTANCE
Specific Trait: "Common smut infection, percentage of plants infected"
Citation: THEOR APPL GENET (1998) 97: 1321-1330
Chromosome: 4
Flanking Markers(s): "UMC31, BNL5.46"
QTL: ZM-PCSI-4-2
Species: *Zea mays*
General Trait: PATHOGEN RESISTANCE
Specific Trait: "Common smut infection, percentage of plants infected"
Citation: THEOR APPL GENET (1998) 97: 1321-1330
Chromosome: 4
Flanking Markers(s): "UMC31, UMC42"
QTL: ZM-PCSI-4-3
Species: *Zea mays*
General Trait: PATHOGEN RESISTANCE
Specific Trait: "Common smut infection, percentage of plants infected"
Citation: THEOR APPL GENET (1998) 97: 1321-1330
Chromosome: 4
Flanking Markers(s): UMC52
QTL: ZM-PCSI-4-5
Species: *Zea mays*
General Trait: PATHOGEN RESISTANCE
Specific Trait: "Common smut infection, percentage of plants infected"
Citation: THEOR APPL GENET (1998) 97: 1321-1330
Chromosome: 4
Flanking Markers(s): "UMC52, BNL15.07"
QTL: ZM-PCSI-4-6
Species: *Zea mays*
General Trait: PATHOGEN RESISTANCE
Specific Trait: "Common smut infection, percentage of plants infected"
Citation: THEOR APPL GENET (1999) 99: 593-598
Chromosome: 4
Flanking Markers(s): UMC104C
QTL: ZM-PCSI-5-1
Species: *Zea mays*
General Trait: PATHOGEN RESISTANCE
Specific Trait: "Common smut infection, percentage of plants infected"
Citation: THEOR APPL GENET (1998) 97: 1321-1330
Chromosome: 5
Flanking Markers(s): "BNL6.25, UMC90"

TABLE 4-continued

Description of disease and pathogen resistance QTLs identified in Table 3.

QTL: ZM-PCSI-5-2
Species: *Zea mays*
General Trait: PATHOGEN RESISTANCE
Specific Trait: "Common smut infection, percentage of plants infected"
Citation: THEOR APPL GENET (1998) 97: 1321-1330
Chromosome: 5
Flanking Markers(s): "BNL6.25, UMC90"
QTL: ZM-PCSI-5-3
Species: *Zea mays*
General Trait: PATHOGEN RESISTANCE
Specific Trait: "Common smut infection, percentage of plants infected"
Citation: THEOR APPL GENET (1998) 97: 1321-1330
Chromosome: 5
Flanking Markers(s): "BNL6.25, UMC90"
QTL: ZM-PCSI-5-4
Species: *Zea mays*
General Trait: PATHOGEN RESISTANCE
Specific Trait: "Common smut infection, percentage of plants infected"
Citation: THEOR APPL GENET (1998) 97: 1321-1330
Chromosome: 5
Flanking Markers(s): "UMC43, UMC1"
QTL: ZM-PCSI-5-5
Species: *Zea mays*
General Trait: PATHOGEN RESISTANCE
Specific Trait: "Common smut infection, percentage of plants infected"
Citation: THEOR APPL GENET (1998) 97: 1321-1330
Chromosome: 5
Flanking Markers(s): "BNL6.25, UMC43"
QTL: ZM-PCSI-5-6
Species: *Zea mays*
General Trait: PATHOGEN RESISTANCE
Specific Trait: "Common smut infection, percentage of plants infected"
Citation: THEOR APPL GENET (1998) 97: 1321-1330
Chromosome: 5
Flanking Markers(s): "UMC27, UMC1"
QTL: ZM-PCSI-5-7
Species: *Zea mays*
General Trait: PATHOGEN RESISTANCE
Specific Trait: "Common smut infection, percentage of plants infected"
Citation: THEOR APPL GENET (1999) 99: 593-598
Chromosome: 5
Flanking Markers(s): "UMC51A, UMC88"
QTL: ZM-PCSI-6-1
Species: *Zea mays*
General Trait: PATHOGEN RESISTANCE
Specific Trait: "Common smut infection, percentage of plants infected"
Citation: THEOR APPL GENET (1998) 97: 1321-1330
Chromosome: 6
Flanking Markers(s): UMC132
QTL: ZM-PCSI-7-1
Species: *Zea mays*
General Trait: PATHOGEN RESISTANCE
Specific Trait: "Common smut infection, percentage of plants infected"
Citation: THEOR APPL GENET (1998) 97: 1321-1330
Chromosome: 7
Flanking Markers(s): "BNL8.39, UMC80"
QTL: ZM-PCSI-7-2
Species: *Zea mays*
General Trait: PATHOGEN RESISTANCE
Specific Trait: "Common smut infection, percentage of plants infected"
Citation: THEOR APPL GENET (1998) 97: 1321-1330
Chromosome: 7
Flanking Markers(s): "UMC80, UMC35"
QTL: ZM-PCSI-7-3
Species: *Zea mays*
General Trait: PATHOGEN RESISTANCE
Specific Trait: "Common smut infection, percentage of plants infected"
Citation: THEOR APPL GENET (1999) 99: 593-598
Chromosome: 7
Flanking Markers(s): "UMC254, UMC80A"
QTL: ZM-PCSI-8-1
Species: *Zea mays*
General Trait: PATHOGEN RESISTANCE
Specific Trait: "Common smut infection, percentage of plants infected"
Citation: THEOR APPL GENET (1998) 97: 1321-1330
Chromosome: 8
Flanking Markers(s): "UMC48, UMC71"
QTL: ZM-PCSI-9-1
Species: *Zea mays*
General Trait: PATHOGEN RESISTANCE
Specific Trait: "Common smut infection, percentage of plants infected"
Citation: THEOR APPL GENET (1998) 97: 1321-1330
Chromosome: 9
Flanking Markers(s): UMC109
QTL: ZM-PCSI-9-2
Species: *Zea mays*
General Trait: PATHOGEN RESISTANCE
Specific Trait: "Common smut infection, percentage of plants infected"
Citation: THEOR APPL GENET (1998) 97: 1321-1330
Chromosome: 9
Flanking Markers(s): "BNL8.05B, BNL14.28"
QTL: ZM-PCSI-9-3
Species: *Zea mays*
General Trait: PATHOGEN RESISTANCE
Specific Trait: "Common smut infection, percentage of plants infected"
Citation: THEOR APPL GENET (1998) 97: 1321-1330
Chromosome: 9
Flanking Markers(s): "BNL5.09, NPI291"
QTL: ZM-PHSI-4-1
Species: *Zea mays*
General Trait: PATHOGEN RESISTANCE
Specific Trait: "Head smut infection, percentage of plants infected"
Citation: THEOR APPL GENET (1999) 99: 593-598
Chromosome: 4
Flanking Markers(s): UMC66A
QTL: ZM-PHSI-5-1
Species: *Zea mays*
General Trait: PATHOGEN RESISTANCE
Specific Trait: "Head smut infection, percentage of plants infected"
Citation: THEOR APPL GENET (1999) 99: 593-598
Chromosome: 5
Flanking Markers(s): BNL7.71
QTL: ZM-PHSI-6-1
Species: *Zea mays*
General Trait: PATHOGEN RESISTANCE
Specific Trait: "Head smut infection, percentage of plants infected"
Citation: THEOR APPL GENET (1999) 99: 593-598

TABLE 4-continued

Description of disease and pathogen resistance QTLs identified in Table 3.

Chromosome: 6
Flanking Markers(s): ASG7
QTL: ZM-PHSI-6-2
Species: *Zea mays*
General Trait: PATHOGEN RESISTANCE
Specific Trait: "Head smut infection, percentage of plants infected"
Citation: THEOR APPL GENET (1999) 99: 593-598
Chromosome: 6
Flanking Markers(s): PHI077
QTL: ZM-PHSI-6-3
Species: *Zea mays*
General Trait: PATHOGEN RESISTANCE
Specific Trait: "Head smut infection, percentage of plants infected"
Citation: THEOR APPL GENET (1999) 99: 593-598
Chromosome: 6
Flanking Markers(s): UMC38A
QTL: ZM-PHSI-8-1
Species: *Zea mays*
General Trait: PATHOGEN RESISTANCE
Specific Trait: "Head smut infection, percentage of plants infected"
Citation: THEOR APPL GENET (1999) 99: 593-598
Chromosome: 8
Flanking Markers(s): "UMC103A, BNGL669"
QTL: ZM-PHSI-8-2
Species: *Zea mays*
General Trait: PATHOGEN RESISTANCE
Specific Trait: "Head smut infection, percentage of plants infected"
Citation: THEOR APPL GENET (1999) 99: 593-598
Chromosome: 8
Flanking Markers(s): UMC30A
QTL: ZM-PHSI-9-1
Species: *Zea mays*
General Trait: PATHOGEN RESISTANCE
Specific Trait: "Head smut infection, percentage of plants infected"
Citation: THEOR APPL GENET (1999) 99: 593-598
Chromosome: 9
Flanking Markers(s): UMC114
QTL: ZM-SCBR-1-1
Species: *Zea mays*
General Trait: PATHOGEN RESISTANCE
Specific Trait: Sugarcane borer
Citation: CROP SCI (1998) 38: 1062-1072
Chromosome: 1
Flanking Markers(s): "NPI286, CSU95C"
QTL: ZM-SCBR-1-2
Species: *Zea mays*
General Trait: PATHOGEN RESISTANCE
Specific Trait: Sugarcane borer
Citation: CROP SCI (1998) 38: 1062-1072
Chromosome: 1
Flanking Markers(s): "CSU92, CSUCMT11B"
QTL: ZM-SCBR-1-3
Species: *Zea mays*
General Trait: PATHOGEN RESISTANCE
Specific Trait: Sugarcane borer
Citation: CROP SCI (1998) 38: 1062-1072
Chromosome: 1
Flanking Markers(s): "BNL8.29A, BNL6.32"
QTL: ZM-SCBR-5-1
Species: *Zea mays*
General Trait: PATHOGEN RESISTANCE
Specific Trait: Sugarcane borer
Citation: CROP SCI (1998) 38: 1062-1072
Chromosome: 5
Flanking Markers(s): "BNL5.40, UMC51A"
QTL: ZM-SCBR-7-1
Species: *Zea mays*
General Trait: PATHOGEN RESISTANCE
Specific Trait: Sugarcane borer
Citation: CROP SCI (1998) 38: 1062-1072
Chromosome: 7
Flanking Markers(s): "UMC110A, CSU36D"
QTL: ZM-SCBR-8-1
Species: *Zea mays*
General Trait: PATHOGEN RESISTANCE
Specific Trait: Sugarcane borer
Citation: CROP SCI (1998) 38: 1062-1072
Chromosome: 8
Flanking Markers(s): "CDO580A, CSU31"
QTL: ZM-SCBR-8-2
Species: *Zea mays*
General Trait: PATHOGEN RESISTANCE
Specific Trait: Sugarcane borer
Citation: CROP SCI (1998) 38: 1062-1072
Chromosome: 8
Flanking Markers(s): "UMC150A, CSU38B"
QTL: ZM-SCBR-9-1
Species: *Zea mays*
General Trait: PATHOGEN RESISTANCE
Specific Trait: Sugarcane borer
Citation: CROP SCI (1998) 38: 1062-1072
Chromosome: 9
Flanking Markers(s): "CSU147, BNLCMT6.06A"
QTL: ZM-SDR-1-1
Species: *Zea mays*
General Trait: PATHOGEN RESISTANCE
Specific Trait: Corn borer stalk damage rating
Citation: THEOR APPL GENET (2000) 101: 907-917
Chromosome: 1
Flanking Markers(s):
QTL: ZM-SDR-5-1
Species: *Zea mays*
General Trait: PATHOGEN RESISTANCE
Specific Trait: Corn borer stalk damage rating
Citation: THEOR APPL GENET (2000) 101: 907-917
Chromosome: 5
Flanking Markers(s):
QTL: ZM-SDR-5-2
Species: *Zea mays*
General Trait: PATHOGEN RESISTANCE
Specific Trait: Corn borer stalk damage rating
Citation: THEOR APPL GENET (2000) 101: 907-917
Chromosome: 5
Flanking Markers(s):
QTL: ZM-SDR-6-1
Species: *Zea mays*
General Trait: PATHOGEN RESISTANCE
Specific Trait: Corn borer stalk damage rating
Citation: THEOR APPL GENET (2000) 101: 907-917
Chromosome: 6
Flanking Markers(s):
QTL: ZM-SDR-8-1
Species: *Zea mays*
General Trait: PATHOGEN RESISTANCE
Specific Trait: Corn borer stalk damage rating
Citation: THEOR APPL GENET (2000) 101: 907-917
Chromosome: 8
Flanking Markers(s):
QTL: ZM-SWCBR-1-1
Species: *Zea mays*
General Trait: PATHOGEN RESISTANCE
Specific Trait: Southwestern corn borer leaf damage
Citation: PLANT BREEDING (1998)

TABLE 4-continued

Description of disease and pathogen resistance QTLs identified in Table 3.

117: 193-202
Chromosome: 1
Flanking Markers(s):
"CSU92, CSUCMT11B"
QTL: ZM-SWCBR-1-2
Species: *Zea mays*
General Trait: PATHOGEN RESISTANCE
Specific Trait: Southwestern corn borer leaf damage
Citation: CROP SCI (1998) 38: 1062-1072
Chromosome: 1
Flanking Markers(s): "NPI97A, UMC157"
QTL: ZM-SWCBR-1-3
Species: *Zea mays*
General Trait: PATHOGEN RESISTANCE
Specific Trait: Southwestern corn borer leaf damage
Citation: CROP SCI (1998) 38: 1062-1072
Chromosome: 1
Flanking Markers(s): "NPI286, CSU95C"
QTL: ZM-SWCBR-1-4
Species: *Zea mays*
General Trait: PATHOGEN RESISTANCE
Specific Trait: Southwestern corn borer leaf damage
Citation: CROP SCI (1998) 38: 1062-1072
Chromosome: 1
Flanking Markers(s):
"CSU92, CSUCMT11B"
QTL: ZM-SWCBR-1-5
Species: *Zea mays*
General Trait: PATHOGEN RESISTANCE
Specific Trait: Southwestern corn borer leaf damage
Citation: CROP SCI (1998) 38: 1062-1072
Chromosome: 1
Flanking Markers(s): "UMC72B, NPI97C"
QTL: ZM-SWCBR-1-6
Species: *Zea mays*
General Trait: PATHOGEN RESISTANCE
Specific Trait: Southwestern corn borer leaf damage
Citation: CROP SCI (1998) 38: 1062-1072
Chromosome: 1
Flanking Markers(s): "NPI286, NPI262"
QTL: ZM-SWCBR-3-1
Species: *Zea mays*
General Trait: PATHOGEN RESISTANCE
Specific Trait: Southwestern corn borer leaf damage
Citation: PLANT BREEDING (1998)
117: 309-318
Chromosome: 3
Flanking Markers(s): "UMC16, UMC63"
QTL: ZM-SWCBR-3-2
Species: *Zea mays*
General Trait: PATHOGEN RESISTANCE
Specific Trait: Southwestern corn borer leaf damage
Citation: PLANT BREEDING (1998)
117: 193-202
Chromosome: 3
Flanking Markers(s): "UMC63A, CSU36C"
QTL: ZM-SWCBR-5-1
Species: *Zea mays*
General Trait: PATHOGEN RESISTANCE
Specific Trait: Southwestern corn borer leaf damage
Citation: PLANT BREEDING (1998)
117: 309-318
Chromosome: 5
Flanking Markers(s): "CSU173, UMC126A"
QTL: ZM-SWCBR-5-2
Species: *Zea mays*
General Trait: PATHOGEN RESISTANCE
Specific Trait: Southwestern corn borer leaf damage
Citation: PLANT BREEDING (1998)
117: 309-318
Chromosome: 5
Flanking Markers(s): "CSU26A, UMC68"
QTL: ZM-SWCBR-5-3
Species: *Zea mays*
General Trait: PATHOGEN RESISTANCE
Specific Trait: Southwestern corn borer leaf damage
Citation: CROP SCI (1998) 38: 1062-1072
Chromosome: 5
Flanking Markers(s): "BNL5.40, UMC51A"
QTL: ZM-SWCBR-6-1
Species: *Zea mays*
General Trait: PATHOGEN RESISTANCE
Specific Trait: Southwestern corn borer leaf damage
Citation: PLANT BREEDING (1998)
117: 309-318
Chromosome: 6
Flanking Markers(s): "UMC140.2, UMC85"
QTL: ZM-SWCBR-6-2
Species: *Zea mays*
General Trait: PATHOGEN RESISTANCE
Specific Trait: Southwestern corn borer leaf damage
Citation: PLANT BREEDING (1998)
117: 309-318
Chromosome: 6
Flanking Markers(s): "UMC65A, UMC21"
QTL: ZM-SWCBR-6-3
Species: *Zea mays*
General Trait: PATHOGEN RESISTANCE
Specific Trait: Southwestern corn borer leaf damage
Citation: CROP SCI (1998) 38: 1062-1072
Chromosome: 6
Flanking Markers(s): "UMC38A, UMC140C"
QTL: ZM-SWCBR-7-1
Species: *Zea mays*
General Trait: PATHOGEN RESISTANCE
Specific Trait: Southwestern corn borer leaf damage
Citation: PLANT BREEDING (1998)
117: 193-202
Chromosome: 7
Flanking Markers(s): "BNL15.21, UMC110"
QTL: ZM-SWCBR-7-2
Species: *Zea mays*
General Trait: PATHOGEN RESISTANCE
Specific Trait: Southwestern corn borer leaf damage
Citation: PLANT BREEDING (1998)
117: 193-202
Chromosome: 7
Flanking Markers(s): "CSU36D, BNL14.07"
QTL: ZM-SWCBR-7-3
Species: *Zea mays*
General Trait: PATHOGEN RESISTANCE
Specific Trait: Southwestern corn borer leaf damage
Citation: CROP SCI (1998) 38: 1062-1072
Chromosome: 7
Flanking Markers(s):
"BNL15.21, UMC110A"
QTL: ZM-SWCBR-8-1
Species: *Zea mays*
General Trait: PATHOGEN RESISTANCE
Specific Trait: Southwestern corn borer leaf damage
Citation: PLANT BREEDING (1998)
117: 309-318
Chromosome: 8
Flanking Markers(s): "CSU29C, UMC103A"
QTL: ZM-SWCBR-8-2

TABLE 4-continued

Description of disease and pathogen resistance QTLs identified in Table 3.

Species: *Zea mays*
General Trait: PATHOGEN RESISTANCE
Specific Trait: Southwestern corn borer leaf damage
Citation: CROP SCI (1998) 38: 1062-1072
Chromosome: 8
Flanking Markers(s): "CDO580A, CSU31"
QTL: ZM-SWCBR-8-3
Species: *Zea mays*
General Trait: PATHOGEN RESISTANCE
Specific Trait: Southwestern corn borer leaf damage
Citation: CROP SCI (1998) 38: 1062-1072
Chromosome: 8
Flanking Markers(s): "UMC150A, CSU38B"
QTL: ZM-SWCBR-8-4
Species: *Zea mays*
General Trait: PATHOGEN RESISTANCE
Specific Trait: Southwestern corn borer leaf damage
Citation: CROP SCI (1998) 38: 1062-1072
Chromosome: 8
Flanking Markers(s): "UMC150A, CSU165A"
QTL: ZM-SWCBR-9-1
Species: *Zea mays*
General Trait: PATHOGEN RESISTANCE
Specific Trait: Southwestern corn borer leaf damage
Citation: PLANT BREEDING (1998) 117: 309-318
Chromosome: 9
Flanking Markers(s): "CSU145A, CSU59"
QTL: ZM-SWCBR-9-2
Species: *Zea mays*
General Trait: PATHOGEN RESISTANCE
Specific Trait: Southwestern corn borer leaf damage
Citation: CROP SCI (1998) 38: 1062-1072
Chromosome: 9
Flanking Markers(s): "CSU158, CSU147"
QTL: ZM-SWCBR-9-3
Species: *Zea mays*
General Trait: PATHOGEN RESISTANCE
Specific Trait: Southwestern corn borer leaf damage
Citation: CROP SCI (1998) 38: 1062-1072
Chromosome: 9
Flanking Markers(s): "CSU56D, UMC95"
QTL: ZM-SWCBR-9-4
Species: *Zea mays*
General Trait: PATHOGEN RESISTANCE
Specific Trait: Southwestern corn borer leaf damage
Citation: CROP SCI (1998) 38: 1062-1072
Chromosome: 9
Flanking Markers(s): "CSU59, CSU93A"
QTL: ZM-TL-1-1
Species: *Zea mays*
General Trait: PATHOGEN RESISTANCE
Specific Trait: Corn borer tunnel length
Citation: THEOR APPL GENET (2000) 101: 907-917
Chromosome: 1
Flanking Markers(s):
QTL: ZM-TL-10-1
Species: *Zea mays*
General Trait: PATHOGEN RESISTANCE
Specific Trait: Corn borer tunnel length
Citation: THEOR APPL GENET (2000) 101: 907-917
Chromosome: 10
Flanking Markers(s):
QTL: ZM-TL-3-1
Species: *Zea mays*
General Trait: PATHOGEN RESISTANCE
Specific Trait: Corn borer tunnel length
Citation: THEOR APPL GENET (2000) 101: 907-917
Chromosome: 3
Flanking Markers(s):
QTL: ZM-TL-5-1
Species: *Zea mays*
General Trait: PATHOGEN RESISTANCE
Specific Trait: Corn borer tunnel length
Citation: THEOR APPL GENET (2000) 101: 907-917
Chromosome: 5
Flanking Markers(s):
QTL: ZM-TL-9-1
Species: *Zea mays*
General Trait: PATHOGEN RESISTANCE
Specific Trait: Corn borer tunnel length
Citation: THEOR APPL GENET (2000) 101: 907-917
Chromosome: 9
Flanking Markers(s):

TABLE 5

Table 5 shows 339 rice probesets corresponding to rice genes induced by pathogen infection

| ProbeSet | 1. Description | *Arabidopsis* Match | Ps | Bc |
|---|---|---|---|---|
| OS000825.1_at (OS000825.1_AT) | Similar to gi|6730938|dbj|BAA89798.1| OsNAC4 protein [*Oryza sativa*] | 68173.m01460#MJK13_17 #AT3g15510#putative jasmonic acid regulatory protein Length = 364 | + | + |
| OS017040_r_at (OS017040_R_AT) | Similar to gi|8778280|gb|AAF79289.1|AC068602_12 F14D16.19 [*Arabidopsis thaliana*] | 68173.m02884#MRI12_1 #AT3g29035#NAM-like protein (No Apical Meristem) Length = 318 | + | + |
| OS002677_at (OS002677_AT) | Similar to gi|3135074|emb|CAA69252.1| anthocyanidin synthase [*Oryza sativa*] | 68170.m06418#F2P24_4 #At1g77330#hypothetical protein Length = 315 | + | + |
| OS008490_at (OS008490_AT) | Similar to gi|2281088|gb|AAB64024.1|putative glucosyltransferase [*Arabidopsis thaliana*] | 51595.m12502#F18O19.7 #At2g43820#putative glucosyltransferase # Length = 449 | + | + |

TABLE 5-continued

Table 5 shows 339 rice probesets corresponding to rice genes induced by pathogen infection

| ProbeSet | 1. Description | *Arabidopsis* Match | Ps | Bc |
|---|---|---|---|---|
| OS002718_f_at (OS002718_F_AT) | Similar to gi|2832328|emb|CAB09729.1|R2R3-MYB transcription factor [*Arabidopsis thaliana*] | 68170.m00506#F9P14_3 #At1g06180#MYB-related protein Length = 246 | + | + |
| OS003517_at (OS003517_AT) | Similar to gi|2055230|dbj|BAA19769.1|SRC2 [*Glycine max*] | 68170.m00770#F7G19_6 #At1g09070#unknown protein Length = 324 | + | − |
| OS003792_f_at (OS003792_F_AT) | Similar to gi|8118443|gb|AAF72993.1|AF261942_1 germin-like protein 2 [*Zea mays*] | 68170.m01752#F14D16_7 #At1g18970#hypothetical protein Length = 220 | + | + |
| OS010810_f_at (OS010810_F_AT) | Similar to Y531_METJA Q57951 *METHANOCOCCUS JANNASCHII.* HYPOTHETICAL PROTEIN MJ0531. | 68173.m05326#T12C14_250 #AT3g62550#putative protein Length = 162 | + | + |
| OS012557_f_at (OS012557_F_AT) | Similar to gi|6715722|gb|AAF26483.1|AC016447_6 unknown protein [*Arabidopsis thaliana*] | 68170.m05561#T22E19_7 #At1g68300#unknown protein Length = 160 | + | + |
| OS019647.1_at (OS019647.1_AT) | Similar to gi|8778748|gb|AAF79756.1|AC009317_15 T30E16.22 [*Arabidopsis thaliana*] | 68170.m00918#F14N23_31 #At1g10410#unknown protein Length = 485 | + | + |
| OS009718.1_at (OS009718.1_AT) | Similar to gi|5103836|gb|AAD39666.1|AC007591_31 Is a member of the PF|00903 gyloxalase family. ESTs gb|T44721, gb|T21844 and gb|AA395404 come from this gene. [*Arabidopsis thaliana*] | 68170.m01402#F9L1_33 #At1g15380#hypothetical protein Length = 174 | + | + |
| OS010405.1_at (OS010405.1_AT) | Similar to gi|1848283|gb|AAB47996.1| Sorghum bicolor aldehyde dehydrogenase (Dha1) mRNA, partial sequence | 68170.m04357#F15I1_19 #At1g54100#hypothetical protein Length = 508 | + | + |
| OS018759.1_at (OS018759.1_AT) | Similar to ODB2_MOUSE P53395 *MUS MUSCULUS* (MOUSE). LIPOAMIDE ACYLTRANSFERASE COMPONENT (E2) PRECURSOR OF BRANCHED-CHAINALPHA-KETO ACID DEHYDROGENASE COMPLEX (EC 2.3.1.—) (DIHYDROLIPOAMIDEBRANCHED CHAIN TRANSACYLASE) (BCKAD E2 SUBUNIT). | 68173.m00603#F3E22_1 #AT3g06850#branched chain alpha-keto acid dehydrogenase E2 subunit Length = 483 | + | − |
| OS001012.1_at (OS001012.1_AT) | Similar to gi|5091498|dbj|BAA78733.1|ESTs AU058067(E20733), AAU058070(E20873) correspond to a region of the predicted gene.; Similar to Populus tremuloides caffeoyl-CoA 3-O-methyltransferase mRNA, complete cds.(U27116) [*Oryza sativa*] | 68164.m03229#F28A23_190 #AT4g34050#caffeoyl-CoA O-methyltransferase-like protein Length = 259 | + | + |
| OS005195_at (OS005195_AT) | Similar to gi|5257275|dbj|BAA81774.1|ESTs AU030740(E60171),AU030739(E60171) correspond to a region of the predicted gene.; Similar to Populus tremuloides caffeoyl-CoA 3-O-methyltransferase. (U27116) [*Oryza sativa*] | 68164.m03229#F28A23_190 #AT4g34050#caffeoyl-CoA O-methyltransferase-like protein Length = 259 | + | + |
| OS000926.1_at (OS000926.1_AT) | Similar to gi|4836876|gb|AAD30579.1|AC007260_10 Similar to dTDP-D-glucose 4,6-dehydratase [*Arabidopsis thaliana*] | 68170.m06541#T30F21_1 #At1g78570#Overlap with bases 87,142-90,425 of 'IGF' BAC clone F9K20, accession number AC005679 putative gamma-glutamyl hydrolase Length = 669 | + | − |
| OS006550.1_at (OS006550.1_AT) | Similar to gi|4138583|emb|CAA71785.1| plastidic ATP/ADP-transporter [*Solanum tuberosum*] | 68170.m06708#F5I6_5# At1g80300#adenine nucleotide translocase Length = 624 | + | + |

TABLE 5-continued

Table 5 shows 339 rice probesets corresponding to rice genes induced by pathogen infection

| ProbeSet | 1. Description | *Arabidopsis* Match | Ps | Bc |
|---|---|---|---|---|
| OS005394_at (OS005394_AT) | Similar to gi\|6689926\|gb\|AAF23903.1\|AF194416_1 MAP kinase homolog [*Oryza sativa*] | 68173.m03635#F9K21_220 #AT3g45640#mitogen-activated protein kinase 3 Length = 370 | + | + |
| OS006501.1_r_at (OS006501.1_R_AT) | Similar to TRPC_BACSU P03964 *BACILLUS SUBTILIS.* INDOLE-3-GLYCEROL PHOSPHATE SYNTHASE (EC 4.1.1.48) (IGPS). | 68172.m04083#MIF21_11 #AT5g48220#indole-3-glycerol phosphate synthase Length = 379 | + | + |
| OS013966.1_at (OS013966.1_AT) | Similar to TRPC_ACICA P00911 *ACINETOBACTER CALCOACETICUS.* INDOLE-3-GLYCEROL PHOSPHATE SYNTHASE (EC 4.1.1.48) (IGPS). | 68172.m04083#MIF21_11 #AT5g48220#indole-3-glycerol phosphate synthase Length = 379 | + | − |
| OS012885_at (OS012885_AT) | Similar to OYEB_SCHPO Q09671 *SCHIZOSACCHAROMYCES POMBE* (FISSION YEAST). PUTATIVE NADPH DEHYDROGENASE C5H10.10 (EC 1.6.99.1) (OLD YELLOW ENZYMEHOMOLOG). | 68170.m06356#F28O16_6 #At1g76690#12-oxophytodienoate reductase (OPR2) Length = 374 | + | + |
| OS018261_s_at (OS018261_S_AT) | Similar to ATTY_RHIME Q02636 *RHIZOBIUM MELILOTI.* TYROSINE AMINOTRANSFERASE (EC 2.6.1.5) (L-TYROSINE: 2-OXOGLUTARATEAMINOTRANSFERASE) (TAT). | 68172.m01760#T20D1_70 #AT5g19550#aspartate aminotransferase Asp2 Length = 405 | + | − |
| OS000536_s_at (OS000536_S_AT) | Similar to gi\|1888551\|gb\|AAB49685.1\| pathogenesis-related protein class 1 [*Oryza sativa*] | 51595.m09638#T6B13.15 #At2g14610#pathogenesis-related PR-1-like protein #identical to GB: M90508 Length = 161 | + | + |
| OS001213_at (OS001213_AT) | Similar to PR1C_TOBAC P09042 *NICOTIANA TABACUM* (COMMON TOBACCO). PATHOGENESIS-RELATED PROTEIN 1C PRECURSOR (PR-1C). | 68173.m01903#MMB12_14 #AT3g19690#PR-1 protein, putative Length = 161 | + | + |
| OS001265_f_at (OS001265_F_AT) | Similar to gi\|945186\|gb\|AAB34609.1\| Tom P14a = pathogenesis-related PR-1 protein {internal fragment} [*Lycopersicon esculentum* = tomatoes, Mill. cv Baby, Phytophthora infestans-infected, leaves, Peptide Partial, 41 aa] | 68164.m03196#T16L1_210 #AT4g33720#pathogenesis-related protein 1 precursor, 19.3K Length = 163 | + | + |
| OS006971.1_at (OS006971.1_AT) | Similar to gi\|4455371\|emb\|CAB36781.1\| putative protein [*Arabidopsis thaliana*] | 51595.m10263#F5H14.13 #At2g20900#putative diacylglycerol kinase # Length = 493 | + | + |
| OS000716_at (OS000716_AT) | Similar to gi\|168473\|gb\|AAA33461.1\| ferredoxin | 51595.m10911#F10A12.19 #At2g27510#putative ferredoxin # Length = 155 | + | + |
| OS021002.1_r_at (OS021002.1_R_AT) | Similar to CPXF_STRGO P18327 *STREPTOMYCES GRISEOLUS.* CYTOCHROME P450-SU2 (EC 1.14.—.—) (P450-CVB1) (CYP105B1). | 51595.m10481#T20D16.19 #At2g23180#putative cytochrome P450 # Length = 516 | + | − |
| OS006912.1_at (OS006912.1_AT) | Similar to gi\|3080393\|emb\|CAA18713.1\| NADH dehydrogenase like protein [*Arabidopsis thaliana*] | 51595.m10253#F5H14.23 #At2g20800#putative NADH-ubiquinone oxireductase # Length = 582 | + | + |
| OS015342_r_at (OS015342_R_AT) | Similar to gi\|9187622\|emb\|CAB97004.1\| WRKY DNA binding protein [*Solanum tuberosum*] | 68172.m01109#T19L5_40 #AT5g13080#WRKY-like protein Length = 145 | + | + |
| OS008661.1_at (OS008661.1_AT) | Similar to gi\|7340697\|emb\|CAB82996.1\| putative protein [*Arabidopsis thaliana*] | 68172.m00123#T7H20_280 #AT5g22230#putative protein Length = 280 | + | − |
| OS008988.1_at (OS008988.1_AT) | Similar to gi\|8096325\|dbj\|BAA95828.1\|ESTs D47168(S12332), D46350(S10967) correspond to a region of the | 68172.m01845#F5O24_290 #AT5g20400#ethylene-forming-enzyme-like dioxygenase-like protein | + | + |

TABLE 5-continued

Table 5 shows 339 rice probesets corresponding to rice genes induced by pathogen infection

| ProbeSet | 1. Description | *Arabidopsis* Match | Ps | Bc |
|---|---|---|---|---|
| | predicted gene.~Similar to *Prunus armeniaca* ethylene-forming-enzyme-like dioxygenase. (U97530) [*Oryza sativa*] | Length = 348 | | |
| OS011949_at (OS011949_AT) | Similar to gi|7484792|pir||T02575 adenylate kinase homolog T16B24.9 - *Arabidopsis thaliana* | 51595.m12054#T16B24.9 #At2g39270#putative adenylate kinase # Length = 295 | + | − |
| OS009208.1_f_at (OS009208.1_F_AT) | Similar to FRI_PHAVU P25699 *PHASEOLUS VULGARIS* (KIDNEY BEAN) (FRENCH BEAN). FERRITIN PRECURSOR. | 68172.m00060#F7A7_120 #AT5g01600#ferritin 1 precursor Length = 255 | + | + |
| OS016732.1_f_at (OS016732.1_F_AT) | Similar to gi|968987|gb|AAB18928.1| ferritin [*Glycine max*] | 68172.m00060#F7A7_120 #AT5g01600#ferritin 1 precursor Length = 255 | + | + |
| OS009655_at (OS009655_AT) | Similar to gi|6539257|gb|AAF15927.1|AC011765_23 putative cytochrome P450 [*Arabidopsis thaliana*] | 51595.m12214#T20B5.9 #At2g40890#putative cytochrome P450 # Length = 508 | + | + |
| OS012786.1_at (OS012786.1_AT) | Similar to S111_PIG P31950 SUS SCROFA (PIG). CALGIZZARIN (S100C PROTEIN). | 68172.m02989#K22F20_20 #AT5g37780#calmodulin 1 (CAM1) Length = 149 | + | + |
| OS002924_at (OS002924_AT) | Similar to gi|6143900|gb|AAF04446.1|AC010718_15 putative calmodulin [*Arabidopsis thaliana*] | 68170.m06351#F28O16_1 #At1g76640#putative calmodulin Length = 159 | + | + |
| OS003390_f_at (OS003390_F_AT) | Similar to CAVP_BRALA P04573 *BRANCHIOSTOMA LANCEOLATUM* (COMMON LANCELET) (AMPHIOXUS). CALCIUM VECTOR PROTEIN (CAVP). | 68173.m03452#T28A8_100 #AT3g43810#calmodulin 7 Length = 149 | + | + |
| OS000303_f_at (OS000303_F_AT) | Similar to gi|7362781|emb|CAB83153.1| calmodulin 7 [*Arabidopsis thaliana*] | 68173.m03452#T28A8_100 #AT3g43810#calmodulin 7 Length = 149 | + | + |
| OS003253_f_at (OS003253_F_AT) | Similar to gi|6041859|gb|AAF02168.1|AC009853_28 putative calmodulin [*Arabidopsis thaliana*] | 68172.m02989#K22F20_20 #AT5g37780#calmodulin 1 (CAM1) Length = 149 | + | + |
| OS004634_at (OS004634_AT) | Similar to NCS2_CAEEL P36609 *CAENORHABDITIS ELEGANS*. NEURONAL CALCIUM SENSOR 2 (NCS-2). | 68173.m04751#T8M16_130 #AT3g56800#calmodulin-3 Length = 149 | + | + |
| OS005026.1_f_at (OS005026.1_F_AT) | Similar to gi|6017121|gb|AAF01604.1|AC009895_25 calmodulin-like protein [*Arabidopsis thaliana*] | 68173.m03452#T28A8_100 #AT3g43810#calmodulin 7 Length = 149 | + | + |
| OS007518.1_f_at (OS007518.1_F_AT) | Similar to MYTR_MITCE P39047 *MITROCOMA CELLULARIA* (*HALISTAURA MITROCOMA*). MITROCOMIN PRECURSOR. | 68173.m03452#T28A8_100 #AT3g43810#calmodulin 7 Length = 149 | + | + |
| OS002157.1_f_at (OS002157.1_F_AT) | Similar to LPSB_LYTPI Q03975 *LYTECHINUS PICTUS* (PAINTED SEA URCHIN). CALCIUM-BINDING PROTEIN LPS1-BETA (FRAGMENT). | 68173.m03452#T28A8_100 #AT3g43810#calmodulin 7 Length = 149 | + | − |
| OS003332.1_f_at (OS003332.1_F_AT) | Similar to PRVM_CHICK P80026 *GALLUS GALLUS* (CHICKEN). PARVALBUMIN, MUSCLE. | 68173.m03452#T28A8_100 #AT3g43810#calmodulin 7 Length = 149 | + | − |
| OS007676.1_f_at (OS007676.1_F_AT) | Similar to MLR2_CAEEL P19626 *CAENORHABDITIS ELEGANS*. MYOSIN REGULATORY LIGHT CHAIN 2. | 68173.m03452#T28A8_100 #AT3g43810#calmodulin 7 Length = 149 | + | − |
| OS022641_s_at (OS022641_S_AT) | Similar to SPCN_CHICK P07751 *GALLUS GALLUS* (CHICKEN). SPECTRIN ALPHA CHAIN, BRAIN (SPECTRIN, NON-ERYTHROID ALPHA CHAIN)(FODRIN ALPHA CHAIN) (SPTAN1). | 68173.m02880#K5K13_11 #AT3g29000#unknown protein Length = 194 | + | + |
| OS008973.1_i_at (OS008973.1_I_AT) | Similar to gi|5441892|dbj|BAA82390.1|ESTs C96653(C10531), C96654(C10531), C28571(C61641) correspond to a | 51595.m12554#F4I1.16 #At2g44350#citrate synthase #similar to GB: X17528, 10 possible | + | + |

TABLE 5-continued

Table 5 shows 339 rice probesets corresponding to rice genes induced by pathogen infection

| ProbeSet | 1. Description | *Arabidopsis* Match | Ps | Bc |
|---|---|---|---|---|
| | region of the predicted gene.; Similar to citrate synthetase. (AC004521) [*Oryza sativa*] | frameshifts in that submission. Length = 474 | | |
| OS010209_r_at (OS010209_R_AT) | Similar to gi|4432862|gb|AAD20710.1| unknown protein [*Arabidopsis thaliana*] | 68164.m03147#F4I10_160 #AT4g33230#pectinesterase-like protein Length = 609 | + | + |
| OS_ORF012127_at (OS_ORF012127_AT) | Open Reading Frame OS_ORF012127 HTC075709-A01.F.30 FRAME: 3 ORF: 14 LEN: 1029 | 68164.m01635#F15J5_20 #AT4g18050#multidrug resistance protein/P-glycoprotein-like Length = 1323 | + | + |
| OS001071_i_at (OS001071_I_AT) | Similar to gi|945194|gb|AAB34615.1| P60 = glycosylated protein disulfide isomerase homolog {N-terminal} [*Triticum aestivum* = wheat, grains, Peptide Partial, 40 aa] | no_hits | + | + |
| OS012484_at (OS012484_AT) | Similar to gi|7340722|emb|CAB82965.1| putative protein [*Arabidopsis thaliana*] | 68170.m02023#F8K7_19 #At1g21750#putative protein disulfide isomerase precursor Length = 501 | + | + |
| OS003806_at (OS003806_AT) | Similar to gi|303844|dbj|BAA02152.1| eukaryotic initiation factor 4A [*Oryza sativa*] | 68173.m01295#MDC16_4 #AT3g13920#eukaryotic protein synthesis initiation factor 4A Length = 412 | + | + |
| OS000564_at (OS000564_AT) | Similar to gi|1771178|emb|CAA67372.1|14-3-3 protein [*Lycopersicon esculentum*] | 68173.m00156#F16B3_15 #AT3g02520#putative 14-3-3 protein Length = 265 | + | + |
| OS000608.1_at (OS000608.1_AT) | Similar to gi|2295928|emb|CAA02460.1| unnamed protein product [*Hordeum vulgare*] | 68173.m00381#F7O18_21 #AT3g04720#hevein-like protein precursor Length = 212 | + | + |
| OS000403_f_at (OS000403_F_AT) | Similar to gi|500617|dbj|BAA03751.1| endochitinase [*Oryza sativa*] | 68173.m01138#T2E22_119 #AT3g12500#hypothetical protein Length = 335 | + | + |
| OS003773_at (OS003773_AT) | Similar to gi|3370780|dbj|BAA31997.1| chitinase [*Oryza sativa*] | 68173.m01138#T2E22_119 #AT3g12500#hypothetical protein Length = 335 | + | + |
| OS002131.1_at (OS002131.1_AT) | Similar to gi|3158376|gb|AAC39468.1| unknown [*Arabidopsis thaliana*] | 68173.m01454#MJK13_11 #AT3g15450#unknown protein Length = 253 | + | − |
| OS009704_s_at (OS009704_S_AT) | Similar to gi|7021730|gb|AAF35411.1| unknown protein [*Arabidopsis thaliana*] | 68164.m02571#F27G19_50 #AT4g27450#putative protein Length = 266 | + | − |
| OS000783.1_at (OS000783.1_AT) | Similar to gi|3218548|dbj|BAA28774.1| alternative oxidase [*Oryza sativa*] | 68173.m02191#MCB17_9 #AT3g22360#alternative oxidase 1b precursor Length = 325 | + | + |
| OS012567_at (OS012567_AT) | Similar to gi|3342251|gb|AAC39506.1|GA3 [*Arabidopsis thaliana*] | 68172.m02310#T1N24_23 #AT5g25900#cytochrome P450 GA3 Length = 509 | + | + |
| OS_ORF008438_at (OS_ORF008438_AT) | Open Reading Frame OS_ORF008438 HTC050670-A01.R.41 FRAME: −1 ORF: 39 LEN: 849 | 68173.m03813#T21L8_170 #AT3g47420#putative protein Length = 513 | + | − |
| OS000639_i_at (OS000639_I_AT) | Similar to E13B_MAIZE P49237 ZEA MAYS (MAIZE). GLUCAN ENDO-1,3-BETA-GLUCOSIDASE, ACIDIC ISOFORM PRECURSOR(EC 3.2.1.39) ((1->3)-BETA-GLUCAN ENDOHYDROLASE) ((1->3)-BETA-GLUCANASE) (BETA-1,3-ENDOGLUCANASE). | 68173.m04798#F28O9_120 #AT3g57260#glucan endo-1,3-beta-D-glucosidase-like protein Length = 340 | + | + |
| OS000818_r_at (OS000818_R_AT) | Similar to gi|930124|emb|CAA34350.1|beta-1,3-glucanase [*Hordeum vulgare*] | 68173.m04795#F28O9_90 90#AT3g57240#beta-1,3-glucanase Length = 278 | + | + |
| OS000959.1_at (OS000959.1_AT) | Similar to E13B_BRACM P49236 *BRASSICA CAMPESTRIS* (FIELD MUSTARD). GLUCAN ENDO-1,3-BETA-GLUCOSIDASE PRECURSOR (EC 3.2.1.39) ((1->3)-BETA-GLUCAN ENDOHYDROLASE) ((1->3)- | 68173.m04797#F28O9_110 #AT3g57260#beta-1,3-glucanase 2 (BG2) Length = 339 | + | + |

TABLE 5-continued

Table 5 shows 339 rice probesets corresponding to rice genes induced by pathogen infection

| ProbeSet | 1. Description | *Arabidopsis* Match | Ps | Bc |
|---|---|---|---|---|
| | BETA-GLUCANASE) (BETA-1,3-ENDOGLUCANASE). | | | |
| OS_ORF016581_at (OS_ORF016581_AT) | Open Reading Frame containing a Sage tag sequence near 3 end OS_ORF016581 ST(F) HTC109857-A01.R.5 FRAME: −3 ORF: 1 LEN: 606 | 51595.m11899#F13M22.21 #At2g37710#putative receptor-like protein kinase #same as GB: X95909 (polymorphism exists at a GA repeat. We found 6 copies in our sequence whereas only 5 copies exist in GB: X95909) Length = 675 | + | + |
| OS001010.1_at (OS001010.1_AT) | Similar to gi\|7248411\|dbj\|BAA92734.1\|ESTs C99632(E20954), C99633(E20954) correspond to a region of the redicted gene. ~Similar to *Arabidopsis thaliana* putative pathogenesis-related protein (U20347) [*Oryza sativa*] | 68164.m00086#AT0ZI1 #AT4g00860#stress-induced protein OZI1 precursor Length = 80 | + | − |
| OS012526.1_at (OS012526.1_AT) | Similar to gi\|4558556\|gb\|AAD22649.1\|AC007138_13 predicted protein of unknown function [*Arabidopsis thaliana*] | 68164.m00187#T7B11_13 #AT4g01870#predicted protein of unknown function Length = 652 | + | + |
| OS008686.1_at (OS008686.1_AT) | Similar to gi\|4206196\|gb\|AAD11584.1\|AAD11584 hypothetical protein [*Arabidopsis thaliana*] | 68170.m01640#F2H15_5 #At1g17830#hypothetical protein Length = 337 | + | + |
| OS016014_at (OS016014_AT) | Similar to gi\|1805652\|emb\|CAA67427.1\| thylakoid-bound ascorbate peroxidase [*Arabidopsis thaliana*] | 68164.m00671#T28D5_80 #AT4g08390#stromal ascorbate peroxidase Length = 372 | + | + |
| OS020785_i_at (OS020785_I_AT) | Similar to C552_PARDE P54820 *PARACOCCUS DENITRIFICANS.* CYTOCHROME C-552 (C552). | 68164.m00834#T5L19_170 #AT4g10040#cytochrome c Length = 112 | + | + |
| OS007966.1_at (OS007966.1_AT) | Similar to gi\|1362095\|pir\|\|S57814 oxidase like protein - tomato | 68172.m02175#K18P6_66 #AT5g24530#flavanone 3-hydroxylase-like protein Length = 341 | + | + |
| OS000452_at (OS000452_AT) | Similar to gi\|7442171\|pir\|\|T04166 thaumatin-like protein - rice | 68164.m00995#T5C23_80 #AT4g11650#osmotin precursor Length = 244 | + | + |
| OS016724_i_at (OS016724_I_AT) | Similar to gi\|1709498\|sp\|P50700\|OSL3_ARATH OSMOTIN-LIKE PROTEIN OSM34 PRECURSOR | 68164.m00995#T5C23_80 #AT4g11650#osmotin precursor Length = 244 | + | + |
| OS002761.1_i_at (OS002761.1_I_AT) | Similar to gi\|2245098\|emb\|CAB10520.1\| ribosomal protein [*Arabidopsis thaliana*] | 68164.m01566#d14730c #AT4g17390#60S ribosomal protein L15 homolog Length = 204 | + | − |
| OS003991_r_at (OS003991_R_AT) | Similar to RL15_BRUPA P41961 *BRUGIA PAHANGI.* 60S RIBOSOMAL PROTEIN L15 (FRAGMENT). | 68164.m01566#d14730c #AT4g17390#60S ribosomal protein L15 homolog Length = 204 | + | − |
| OS004264.1_s_at (OS004264.1_S_AT) | Similar to R15B_YEAST P54780 *SACCHAROMYCES CEREVISIAE* (BAKER S YEAST). 60S RIBOSOMAL PROTEIN YL10 B (L13) (RP15R) (YP18). | 68164.m01566#d14730c #AT4g17390#60S ribosomal protein L15 homolog Length = 204 | + | − |
| OS_ORF003479_at (OS_ORF003479_AT) | Open Reading Frame OS_ORF003479 HTC020205-A01.10FRAME: −1 ORF: 6 LEN 966 | 68170.m02983#F6N18_8 #At1g32700#unknown protein Length = 244 | + | + |
| OS001195.1_i_at (OS001195.1_I_AT) | Similar to R11B_TOBAC Q40521 *NICOTIANA TABACUM* (COMMON TOBACCO). RAS-RELATED PROTEIN RAB11B. | 68170.m00840#F21M12_2 #At1g09630#putative RAS-related protein, RAB11C Length = 217 | + | + |
| OS011233_at (OS011233_AT) | Similar to gi\|4775261\|emb\|CAB42613.1\| unnamed protein product [*Arabidopsis thaliana*] | 68164.m01914#T13K14_20 #AT4g20860#berberine bridge enzyme-like protein Length = 530 | + | + |
| OS015036_at (OS015036_AT) | Similar to gi\|8096609\|dbj\|BAA96181.1\|EST AU056651(S20760) corresponds to | 51595.m11632#F19I3.19 #At2g34960#putative amino acid transporter # | + | + |

TABLE 5-continued

Table 5 shows 339 rice probesets corresponding to rice genes induced by pathogen infection

| ProbeSet | 1. Description | *Arabidopsis* Match | Ps | Bc |
|---|---|---|---|---|
| | a region of the predicted gene.~Similar to *Arabidopsis thaliana* chromosome II BAC F19I3; putative amino acid transporter (AC004238) [*Oryza sativa*] | Length = 569 | | |
| OS018830_i_at (OS018830_I_AT) | Similar to OPT1_CAEEL Q17758 *CAENORHABDITIS ELEGANS*. HYPOTHETICAL OLIGOPEPTIDE TRANSPORTER C06G8.2. | 68170.m04965#F19K23_13 #At1g62200#hypothetical protein Length = 583 | + | + |
| OS025228.1_at (OS025228.1_AT) | Similar to gi\|2262116\|gb\|AAB63624.1\|cellulose synthase isolog | 68170.m04531#F14J16_20 #At1g55850#cellulose synthase catalytic subunit, putative Length = 748 | + | + |
| OS012146.1_at (OS012146.1_AT) | Similar to gi\|2842480\|emb\|CAA16877.1\|ADP, ATP carrier-like protein [*Arabidopsis thaliana*] | 68164.m02664#F20O9_60 #AT4g28390#ADP, ATP carrier-like protein Length = 379 | + | + |
| OS000597_f_at (OS000597_F_AT) | Similar to gi\|2911393\|gb\|AAC04347.1\|cell division cycle protein 48 [*Hordeum vulgare*] | 68173.m00866#F8A24_11 #AT3g09840#putative transitional endoplasmic reticulum ATPase Length = 809 | + | − |
| OS012376_at (OS012376_AT) | Similar to gi\|3297816\|emb\|CAA19874.1\| putative protein [*Arabidopsis thaliana*] | 68164.m03216#F17I5_110 #AT4g33920#putative protein Length = 380 | + | + |
| OS022225.1_i_at (OS022225.1_I_AT) | Similar to NAHG_PSEPU P23262 *PSEUDOMONAS PUTIDA*. SALICYLATE HYDROXYLASE (EC 1.14.13.1) (SALICYLATE 1-MONOOXYGENASE). | 68164.m03670#F20M13_100 #AT4g38540#monooxygenase 2 (MO2) Length = 407 | + | + |
| OS014904_at (OS014904_AT) | Similar to gi\|294285\|gb\|AAA33840.1\| 3-deoxy-D-arabino-heptulosonate 7-phosphate synthase | 68170.m02106#F12K8_24 #At1g22410#Putative phospho-2-dehydro-3-deoxyheptonate aldolase 1 precursor Length = 527 | + | + |
| OS012114_at (OS012114_AT) | Similar to gi\|9295735\|gb\|AAF87041.1\|AC006535_19 T24P13.17 [*Arabidopsis thaliana*] | 68173.m03821#F1P2_50 #AT3g47500#H-protein promoter binding factor-2a Length = 448 | + | − |
| OS019568_at (OS019568_AT) | Similar to gi\|2244896\|emb\|CAB10318.1\| HSR201 like protein [*Arabidopsis thaliana*] | 68172.m05667#MBK5_2 #AT5g63560#acyltransferase-like protein Length = 426 | + | + |
| OS008316.1_at (OS008316.1_AT) | Similar to gi\|169953\|gb\|AAA33959.1\| ferritin light chain | 51595.m12155#T3G21.7 #At2g40300#putative ferritin # Length = 259 | + | + |
| OS018530_at (OS018530_AT) | Similar to FRIH_SALSA P49946 *SALMO SALAR* (ATLANTIC SALMON). FERRITIN, HEAVY SUBUNIT (FERRITIN H). | no_hits | + | + |
| OS007368_at (OS007368_AT) | Similar to HSCA_PSEAE Q51382 *PSEUDOMONAS AERUGINOSA*. CHAPERONE PROTEIN HSCA HOMOLOG (FRAGMENT). | 68172.m00818#F17I14_220 #AT5g09590#heat shock protein 70 (Hsc70-5) Length = 682 | + | + |
| OS000294_at (OS000294_AT) | Similar to gi\|21417\|emb\|CAA78035.1\| BiP [*Solanum tuberosum*] | 68172.m03425#MJC20_12 #AT5g42020#luminal binding protein (dbj\|BAA13948.1) Length = 668 | + | + |
| OS015102_at (OS015102_AT) | Similar to gi\|5360659\|dbj\|BAA82095.1\| anthranilate synthase alpha 2 subunit [*Oryza sativa*] | 51595.m11123#T27A1621 #At2g29690#anthranilate synthase, alpha subunit #identical to GB: M92354 Length = 621 | + | + |
| OS001240_at (OS001240_AT) | Similar to gi\|2425101\|gb\|AAB81720.1\|cationic peroxidase [*Oryza sativa*] | 68172.m01584#MVA3_170 #AT5g17820#peroxidase ATP13a Length = 313 | + | + |
| OS005201_at (OS005201_AT) | Similar to gi\|2443459\|gb\|AAB71383.1\| peroxidase [*Oryza sativa*] | 68172.m01319#F8M21_70 #AT5g15180#prx10 peroxidase-like protein Length = 329 | + | + |
| OS005858_f_at (OS005858_F_AT) | Similar to gi\|8656007\|gb\|AAF78280.1\|AC020576_24 Contains similarity to peroxidase ATP18a from *Arabidopsis thaliana* gb\|X98804 and contains a | 68170.m03656#F27F5_6 #At1g44970#peroxidase-like protein emb\|CAB62621.1; similar to ESTs gb\|T76544.1, | + | + |

TABLE 5-continued

Table 5 shows 339 rice probesets corresponding to rice genes induced by pathogen infection

| ProbeSet | 1. Description | *Arabidopsis* Match | Ps | Bc |
|---|---|---|---|---|
| | peroxidase PF|00141 domain. EST gb|T76544 comes from this gene. This gene may be cut off. | gb|AA394647.1 Length = 346 | | |
| OS002043_at (OS002043_AT) | Similar to PER1_HORVU P27337 *HORDEUM VULGARE* (BARLEY). PEROXIDASE 1 PRECURSOR (EC 1.11.1.7). | 68172.m00442#K18I23_14 #AT5g05340#peroxidase Length = 324 | + | − |
| OS006598.1_at (OS006598.1_AT) | Similar to SUCA_ARATH P53586 *ARABIDOPSIS THALIANA* (MOUSE-EAR CRESS). SUCCINYL-COA LIGASE (GDP-FORMING), ALPHA-CHAIN PRECURSOR (EC 6.2.1.4)(SUCCINYL-COA SYNTHETASE, ALPHA CHAIN) (SCS-ALPHA) (FRAGMENT). | 68172.m02030#MKD15_11 #AT5g23250#succinyl-CoA synthetase, alpha subunit Length = 341 | + | + |
| OS015603_s_at (OS015603_S_AT) | Similar to gi|166792|gb|AAA32835.1| phosphoribosylanthranilate transferase | 68172.m01601#MCM23_6 #AT5g17990#anthranilate phosphoribosyltransferase, chloroplast precursor (sp|Q02166) Length = 444 | + | + |
| OS001045_f_at (OS001045_F_AT) | Similar to gi|2429294|gb|AAC49822.1| peroxidase [*Oryza sativa*] | 68172.m00442#K18I23_14 #AT5g05340#peroxidase Length = 324 | + | + |
| OS_ORF019683_at (OS_ORF019683_AT) | Open Reading Frame containing a Sage tag sequence near 3 end OS_ORF019683 ST(F) HTC133077-A01.R.6 FRAME: 2 ORF: 1 LEN: 747 | 68172.m02313#T1N24_22 #AT5g25930#receptor-like protein kinase-like Length = 1005 | + | + |
| OS000739_at (OS000739_AT) | Similar to gi|5734442|emb|CAB52690.1|hexose transporter [*Lycopersicon esculentum*] | 68170.m00995#T28P6_18 #At1g11260#glucose transporter Length = 522 | + | + |
| OS015512.1_at (OS015512.1_AT) | Similar to gi|6863054|dbj|BAA90487.1|heat shock protein 90 [*Oryza sativa*] | 68164.m02246#T22A6_20 #AT4g24190#HSP90-like protein Length = 823 | + | + |
| OS007132_f_at (OS007132_F_AT) | Similar to gi|7433039|pir||T03912 peroxidase (EC 1.11.1.7) poxN - rice | 68172.m00442#K18I23_14 #AT5g05340#peroxidase Length = 324 | + | + |
| OS001918.1_at (OS001918.1_AT) | Similar to gi|223430|prf||0805309A dehydrogenase Adh1, alcohol [*Zea mays*] | 68170.m06397#F22K20_19 #At1g77120#Alcohol Dehydrogenase Length = 379 | − | + |
| OS002619_s_at (OS002619_S_AT) | Similar to gi|4680365|gb|AAD27644.1|AF133666_1 alcohol dehydrogenase 1 [*Oryza sativa*] | 68170.m06397#F22K20_19 #At1g77120#Alcohol Dehydrogenase Length = 379 | − | + |
| OS001113.1_s_at (OS001113.1_S_AT) | Similar to G3P_CANFA Q28259 *CANIS FAMILIARIS* (DOG). GLYCERALDEHYDE 3-PHOSPHATE DEHYDROGENASE (EC 1.2.1.12) (GAPDH)(FRAGMENT). | 68170.m06622#T8K14_5 #At1g79530#hypothetical protein Length = 422 | − | + |
| OS003022.1_at (OS003022.1_AT) | Similar to G3P_BURSO P52694 *BURKHOLDERIA SOLANACEARUM* (*PSEUDOMONAS SOLANACEARUM*). GLYCERALDEHYDE 3-PHOSPHATE DEHYDROGENASE (EC 1.2.1.12) (GAPDH)(FRAGMENT). | 68173.m00318#T6K12_26 #AT3g04120#glyceraldehyde-3-phosphate dehydrogenase C subunit (GapC) Length = 338 | − | + |
| OS000990.1_at (OS000990.1_AT) | Similar to ACOC_CUCMA P49608 *CUCURBITA MAXIMA* (PUMPKIN) (WINTER SQUASH). ACONITATE HYDRATASE, CYTOPLASMIC (EC 4.2.1.3) (CITRATE HYDROLYASE) (ACONITASE). | 51595.m08949#T3P4.5# At2g05710#cytoplasmic aconitate hydratase # Length = 898 | − | + |
| OS018213.1_at (OS018213.1_AT) | Similar to ACON_GRAVE P49609 *GRACILARIA VERRUCOSA*. ACONITATE HYDRATASE, MITOCHONDRIAL PRECURSOR (EC 4.2.1.3) (CITRATEHYDROLYASE) (ACONITASE). | 51595.m08949#T3P4.5# At2g05710#cytoplasmic aconitate hydratase # Length = 898 | − | + |

TABLE 5-continued

Table 5 shows 339 rice probesets corresponding to rice genes induced by pathogen infection

| ProbeSet | 1. Description | *Arabidopsis* Match | Ps | Bc |
|---|---|---|---|---|
| OS016132_f_at (OS016132_F_AT) | Similar to IDH_METJA Q58991 *METHANOCOCCUS JANNASCHII*. ISOCITRATE DEHYDROGENASE (NADP) (EC 1.1.1.42) (OXALOSUCCINATEDECARBOXYLASE) (IDH) (NADP+-SPECIFIC ICDH) (IDP). | 68164.m03350#F23E12__180 #AT4g35260#NAD + dependent isocitrate dehydrogenase subunit 1 Length = 367 | − | + |
| OS018548.1_f_at (OS018548.1_F_AT) | Similar to LEU3_NEUCR P34738 *NEUROSPORA CRASSA*. 3-ISOPROPYLMALATE DEHYDROGENASE (EC 1.1.1.85) (BETA-IPM DEHYDROGENASE)(IMDH) (3-IPM-DH). | 68164.m03350#F23E12__180 #AT4g35260#NAD + dependent isocitrate dehydrogenase subunit 1 Length = 367 | − | + |
| OS_ORF017286_at (OS_ORF017286_AT) | Open Reading Frame OS_ORF017286 ST(R) HTC115246-A01.F.14 FRAME: −2 ORF: 13 LEN: 753 | 68173.m03823#F1P2__70 #AT3g47520#chloroplast NAD-dependent malate dehydrogenase Length = 403 | − | + |
| OS001312_f_at (OS001312_F_AT) | Similar to gi\|7431175\|pir\|\|T06327 malate dehydrogenase (EC 1.1.1.37), mitochondrial - soybean (fragment) | 68173.m03823#F1P2__70 #AT3g47520#chloroplast NAD-dependent malate dehydrogenase Length = 403 | − | + |
| OS002766_f_at (OS002766_F_AT) | Similar to MDHM_HUMAN P40926 *HOMO SAPIENS* (HUMAN). MALATE DEHYDROGENASE, MITOCHONDRIAL PRECURSOR (EC 1.1.1.37)(FRAGMENT). | 68173.m03823#F1P2__70 #AT3g47520#chloroplast NAD-dependent malate dehydrogenase Length = 403 | − | + |
| OS004296_i_at (OS004296_I_AT) | Similar to gi\|3256066\|emb\|CAA74320.1\| chloroplast NAD-MDH [*Arabidopsis thaliana*] | 68173.m03823#F1P2__70 #AT3g47520#chloroplast NAD-dependent malate dehydrogenase Length = 403 | − | + |
| OS012070.1_at (OS012070.1_AT) | Similar to ENO1_MAIZE P26301 *ZEA MAYS* (MAIZE). ENOLASE 1 (EC 4.2.1.11) (2-PHOSPHOGLYCERATE DEHYDRATASE 1) (2-PHOSPHO-D-GLYCERATE HYDRO-LYASE 1). | 51595.m11783#F1O11.16 #At2g36530#enolase (2-phospho-D-glycerate hydroylase) # Length = 444 | − | + |
| OS011868.1_s_at (OS011868.1_S_AT) | Similar to gi\|4512675\|gb\|AAD21729.1\|putative citrate synthase [*Arabidopsis thaliana*] | 51595.m12401#F7D19.21 #At2g42790#putative citrate synthase # Length = 509 | − | + |
| OS015167_at (OS015167_AT) | Similar to gi\|7630070\|emb\|CAB88292.1\|citrate synthase-like protein [*Arabidopsis thaliana*] | 68173.m04946#T20N10__100 #AT3g58750#citrate synthase-like protein Length = 514 | − | + |
| OS015078_at (OS015078_AT) | Similar to gi\|3410961\|dbj\|BAA32276.1\|3-phosphoshikimate 1-carboxyvinyltransferase [*Oryza sativa*] | 51595.m12648#F4L23.19 #At2g45300#5-enolpyruvylshikimate-3-phosphate (EPSP) synthase #identical to GB:X06613:ATEPSPS Length = 520 | − | + |
| OS020639.1_at (OS020639.1_AT) | Similar to gi\|66619\|pir\|\|XUTOVS 3-phosphoshikimate 1-carboxyvinyltransferase (EC 2.5.1.19) precursor - tomato | 51595.m12648#F4L23.19 #At2g45300#5-enolpyruvylshikimate-3-phosphate (EPSP) synthase #identical to GB:X06613:ATEPSPS Length = 520 | − | + |
| OS005552_at (OS005552_AT) | Similar to gi\|393184\|gb\|AAC37345.1\| alcohol dehydrogenase | 68173.m04239#T18N14__60 #AT3g51680#short-chain alcohol dehydrogenase-like protein Length = 303 | − | + |
| OS010415.1_i_at (OS010415.1_I_AT) | Similar to ARDH_CANTR P50166 *CANDIDA TROPICALIS* (YEAST). D-ARABINITOL 2-DEHYDROGENASE (RIBULOSE FORMING) (EC 1.1.1.250) (ARDH). | 68164.m00314#F4C21__6 #AT4g03140#putative alcohol dehydrogenase Length = 283 | − | + |

TABLE 5-continued

Table 5 shows 339 rice probesets corresponding to rice genes induced by pathogen infection

| ProbeSet | 1. Description | *Arabidopsis* Match | Ps | Bc |
|---|---|---|---|---|
| OS012482.1_at (OS012482.1_AT) | Similar to gi\|2695705\|emb\|CAA71588.1\| CONSTANS [*Arabidopsis thaliana*] | 68173.m00141#F11A12__106 #AT3g02380#hypothetical protein Length = 347 | − | + |
| OS004163_at (OS004163_AT) | Similar to gi\|7267294\|emb\|CAB81076.1\| putative protein [*Arabidopsis thaliana*] | 68173.m04165#F18B3__220 #AT3g50940#BCS1 protein-like protein Length = 480 | − | + |
| OS000314_r_at (OS000314_R_AT) | Similar to TLP_ORYSA P31110 *ORYZA SATIVA* (RICE). THAUMATIN-LIKE PROTEIN PRECURSOR. | 68164.m00995#T5C23__80 #AT4g11650#osmotin precursor Length = 244 | − | + |
| OS009171_s_at (OS009171_S_AT) | Similar to gi\|170753\|gb\|AAA34296.1\| initiation factor (iso)4F p28 subunit | 68172.m02775#MJE4__8 #AT5g35620#eIF4Eiso protein (emb\|CAA71579.1) Length = 198 | − | + |
| OS007248.1_s_at (OS007248.1_S_AT) | Similar to CT2B_MOUSE P12400 *MUS MUSCULUS* (MOUSE). CTLA-2-BETA PROTEIN PRECURSOR (FRAGMENT). | 68173.m01871#MLD14__12 #AT3g19400#putative cysteine proteinase RD21A precursor Length = 359 | − | + |
| OS011590_at (OS011590_AT) | Similar to gi\|129231\|sp\|P25776\|ORYA_ORYSA ORYZAIN ALPHA CHAIN PRECURSOR | 68172.m03536#MMG4__7 #AT5g43060#cysteine protease component of protease-inhibitor complex Length = 463 | − | + |
| OS005484.1_at (OS005484.1_AT) | Similar to gi\|2612941\|gb\|AAB88295.1\|CLA1 transketolase-like protein [*Oryza sativa*] | 68164.m01385#dl3821w #AT4g15560#DEF (CLA1) protein Length = 717 | − | + |
| OS002170.1_at (OS002170.1_AT) | Similar to gi\|7076784\|emb\|CAB75899.1\|2-oxoglutarate dehydrogenase, E1 subunit-like protein [*Arabidopsis thaliana*] | 68173.m04612#T22E16__70 #AT3g55410#2-oxoglutarate dehydrogenase, E1 subunit-like protein Length = 1009 | − | + |
| OS_ORF003709_f_at (OS_ORF003709_F_AT) | Open Reading Frame containing a Sage tag sequence near 3 end OS_ORF003709 ST(F) HTC021582-A01.12 FRAME: −1 ORF: 1 LEN: 669 | no_hits | − | − |
| OS_ORF005000_at (OS_ORF005000_AT) | Open Reading Frame containing a Sage tag sequence near 3 end OS_ORF005000 ST(F) HTC029547-A01.F.5 FRAME: −2 ORF: 1 LEN: 510 | 68170.m01992#F24J8__19 #At1g21440#hypothetical protein Length = 317 | − | − |
| OS_ORF008199_at (OS_ORF008199_AT) | Open Reading Frame OS_ORF008199 ST(R) HTC049023-A01.15 FRAME: −2 ORF: 34 LEN: 555 | 68173.m00678#MLP3__5 #AT3g07600#unknown protein Length = 157 | − | − |
| OS_ORF019129_at (OS_ORF019129_AT) | Open Reading Frame containing a Sage tag sequence near 3 end OS_ORF019129 ST(F) HTC128298-A01.F.10 FRAME: −2 ORF: 6 LEN: 507 | 68164.m03465#C7A10__890 #AT4g36470#hypothetical protein Length = 371 | − | − |
| OS_ORF020195_at (OS_ORF020195_AT) | Open Reading Frame OS_ORF020195 HTC136297-A01.F.27 FRAME: −2 ORF: 18 LEN: 744 | 68170.m05599#F24J5__15 #At1g68690#protein kinase, putative Length = 708 | − | − |
| OS000107_at (OS000107_AT) | Similar to gi\|7262431\|dbj\|BAA92788.1\|EST AU069817(E3652) corresponds to a region of the predicted gene.; hypothetical protein [*Oryza sativa*] | no_hits | − | − |
| OS000185_at (OS000185_AT) | Similar to gi\|6979322\|gb\|AAF34415.1\|AF172282_4 unknown protein [*Oryza sativa*] | no_hits | − | − |
| OS000187_at (OS000187_AT) | Similar to gi\|7363280\|dbj\|BAA93024.1\|ESTs D24970(R2869), AU031961(R2869) correspond to a region of the predicted gene.~Similar to *Zea mays* putative cytosolic 6-phosphogluconate dehydrogenase (AF061838) [*Oryza sativa*] | 68173.m00140#F11A12__104 #AT3g02360#hypothetical protein Length = 486 | − | − |

TABLE 5-continued

Table 5 shows 339 rice probesets corresponding to rice genes induced by pathogen infection

| ProbeSet | 1. Description | *Arabidopsis* Match | Ps | Bc |
|---|---|---|---|---|
| OS000281.1_at (OS000281.1_AT) | Similar to gi\|5816996\|emb\|CAB53651.1\| ribosomal protein L32-like protein [*Arabidopsis thaliana*] | 68164.m01640#F15J5_70 #AT4g18100#ribosomal protein L32-like protein Length = 133 | – | – |
| OS000286_at (OS000286_AT) | Similar to gi\|2739219\|emb\|CAA04565.1\|rpS28 [*Hordeum vulgare*] | 68172.m05727#MHJ24_12 #AT5g64140#40S ribosomal protein S28 (sp\|P34789) Length = 64 | – | – |
| OS000313_at (OS000313_AT) | Similar to gi\|1173350\|sp\|P42553\|S1FA_ORYSA DNA BINDING PROTEIN S1FA | 51595.m11840#T2N18.12 #At2g37120#unknown protein # Length = 76 | – | – |
| OS000318_at (OS000318_AT) | Similar to gi\|6682226\|gb\|AAF23278.1\|AC016661_3 unknown protein [*Arabidopsis thaliana*] | 68173.m00828#F11F8_3 #AT3g09460#unknown protein Length = 35 | – | – |
| OS000336.1_s_at (OS000336.1_S_AT) | Similar to gi\|8439545\|gb\|AAF74983.1\|AF082893_1 methionine synthase [*Solanum tuberosum*] | 68172.m01594#MPI7_60 #AT5g17920#5-methyltetrahydropteroyltriglutamate-homocysteine S-methyltransferase Length = 765 | – | – |
| OS000339_r_at (OS000339_R_AT) | Similar to RL1X_ARATH P51418 *ARABIDOPSIS THALIANA* (MOUSE-EAR CRESS). 60S RIBOSOMAL PROTEIN L18A (FRAGMENT). | 51595.m11585#T31E10.18 #At2g34480#60S ribosomal protein L18A # Length = 178 | – | – |
| OS000349_at (OS000349_AT) | Similar to gi\|2696231\|dbj\|BAA23811.1\| chitinase [*Oryza sativa*] | 68172.m02117#MZF18_2 #AT5g24090#acidic endochitinase (dbj\|BAA21861.1) Length = 302 | – | – |
| OS000352_at (OS000352_AT) | Similar to gi\|2696221\|dbj\|BAA23806.1\| chitinase [*Oryza sativa*] | 68172.m02117#MZF18_2 #AT5g24090#acidic endochitinase (dbj\|BAA21861.1) Length = 302 | – | – |
| OS000404_at (OS000404_AT) | Similar to gi\|7635919\|emb\|CAB88391.1\| putative Bowman Birk trypsin inhibitor [*Oryza sativa*] | no_hits | – | – |
| OS000424_at (OS000424_AT) | Similar to gi\|7619799\|emb\|CAB88208.1\| putative Bowman Birk trypsin inhibitor [*Oryza sativa*] | no_hits | – | – |
| OS000565_s_at (OS000565_S_AT) | Similar to gi\|7431262\|pir\|\|T01660 probable phosphogluconate dehydrogenase (decarboxylating) (EC 1.1.1.44) - maize (fragment) | 68172.m03389#MBK23_20 #AT5g41670#6-phosphogluconate dehydrogenase Length = 487 | – | – |
| OS000590_f_at (OS000590_F_AT) | Similar to CHI3_ARAHY Q06015 *ARACHIS HYPOGAEA* (PEANUT). ENDOCHITINASE 3 (EC 3.2.1.14) (CHIT 3) (FRAGMENT). | 68173.m01138#T2E22_119 #AT3g12500#hypothetical protein Length = 335 | – | – |
| OS000613_at (OS000613_AT) | Similar to ACEA_GOSHI P17069 *GOSSYPIUM HIRSUTUM* (UPLAND COTTON). ISOCITRATE LYASE (EC 4.1.3.1) (ISOCITRASE) (ISOCITRATASE) (ICL). | 68173.m02117#MSD21_3 #AT3g21720#putative isocitrate lyase Length = 573 | – | – |
| OS000637_i_at (OS000637_I_AT) | Similar to gi\|6900312\|emb\|CAB71339.1\| putative Bci-6 protein [*Hordeum vulgare*] | 68164.m02315#F13M23_30 #AT4g24890#putative protein Length = 545 | – | – |
| OS000638_at (OS000638_AT) | Similar to gi\|22236\|emb\|CAA31057.1\| catalase-3 (AA 1-495) [*Zea mays*] | 68164.m03333#M4E13_140 #AT4g35090#catalase Length = 492 | – | – |
| OS000679_at (OS000679_AT) | Similar to gi\|2244857\|emb\|CAB10279.1\| ribosomal protein [*Arabidopsis thaliana*] | 68164.m01329#dl3545w #AT4g15000#ribosomal protein Length = 135 | – | – |
| OS000725_at (OS000725_AT) | Similar to gi\|5103810\|gb\|AAD39640.1\|AC007591_5 Similar to gb\|X79273 cytochrome c reductase hinge protein subunit from *Solanum tuberosum*. | 51595.m08495#F23H14.6 #At2g01090#putative ubiquinol-cytochrome c reductase #similar to ubiquinol-cytochrome c | – | – |

TABLE 5-continued

Table 5 shows 339 rice probesets corresponding to rice genes induced by pathogen infection

| ProbeSet | 1. Description | *Arabidopsis* Match | Ps | Bc |
|---|---|---|---|---|
| | ESTs gb|T45282 and gb|T21596 come from this gene. [*Arabidopsis thaliana*] | reductase GB: P48504 from [*Solanum tuberosum*] Length = 62 | | |
| OS000860_at (OS000860_AT) | Similar to gi|4103324|gb|AAD01737.1|GDP-mannose pyrophosphorylase [*Solanum tuberosum*] | 51595.m12103#T517.7# At2g39770#putative GDP-mannose pyrophosphorylase Length = 361 | – | – |
| OS000876_s_at (OS000876_S_AT) | Similar to gi|7547148|gb|AAF42956.2| phosphate transporter [*Oryza sativa*] | 68173.m04541#T5N23_60 #AT3g54700#phosphate transport protein Length = 535 | – | – |
| OS000907_s_at (OS000907_S_AT) | Similar to gi|585960|sp|P38389|S61B_ARATH PROTEIN TRANSPORT PROTEIN SEC61 BETA SUBUNIT | 68173.m05125#T8B10_200 #AT3g60540#transport protein subunit-like Length = 81 | – | – |
| OS000985_at (OS000985_AT) | Similar to gi|493947|pdb|1COA|I Chain I, Chymotrypsin Inhibitor 2 (Ci2) Mutant With Ile 76 Replaced By Val (I76v) | 68172.m03592#K9D7_8 #AT5g43580#unknown protein Length = 72 | – | – |
| OS001030.1_at (OS001030.1_AT) | Similar to gi|485814|dbj|BAA03901.1|WZF1 [*Triticum aestivum*] | 68173.m01892#MMB12_3 #AT3g19580#zinc finger protein, putative Length = 273 | – | – |
| OS001060_s_at (OS001060_S_AT) | Similar to gi|169807|gb|AAA33912.1| oryzastatin | 68173.m01137#T2E22_120 #AT3g12490#hypothetical protein Length = 234 | – | – |
| OS001062_at (OS001062_AT) | Similar to gi|4469124|emb|CAB38313.1| methionin synthase-like enzyme [*Arabidopsis thaliana*] | 68173.m00283#F20H23_19 #AT3g03780#putative methionine synthase Length = 765 | – | – |
| OS001119_at (OS001119_AT) | Similar to RR10_PORPU P51286 *PORPHYRA PURPUREA*. CHLOROPLAST 30S RIBOSOMAL PROTEIN S10. | 68173.m01202#MJG19_6 #AT3g13120#30S ribosomal protein S10, putative Length = 191 | – | – |
| OS001127_at (OS001127_AT) | Similar to CHIA_CUCSA P17541 *CUCUMIS SATIVUS* (CUCUMBER). ACIDIC ENDOCHITINASE PRECURSOR (EC 3.2.1.14). | 68172.m02117#MZF18_2 #AT5g24090#acidic endochitinase (dbj|BAA21861.1) Length = 302 | – | – |
| OS001183_at (OS001183_AT) | Similar to TYD1_PAPSO P54768 *PAPAVER SOMNIFERUM* (OPIUM POPPY). TYROSINE/DOPA DECARBOXYLASE 1 (DOPA DECARBOXYLASE (EC 4.1.1.28) (DDC)/TYROSINE DECARBOXYLASE (EC 4.1.1.25)). | 51595.m10207#F11A3.11 #At2g20340#putative tyrosine decarboxylase # Length = 479 | – | – |
| OS001189.1_f_at (OS001189.1_F_AT) | Similar to RL39_MAIZE P51425 *ZEA MAYS* (MAIZE). 60S RIBOSOMAL PROTEIN L39. | 51595.m10682#T22F11.20 #At2g25210#60S ribosomal protein L39 # Length = 44 | – | – |
| OS001218.1_at (OS001218.1_AT) | Similar to RS1A_ARATH P42798 *ARABIDOPSIS THALIANA* (MOUSE-EAR CRESS). 40S RIBOSOMAL PROTEIN S15A. | 68172.m05295#mmn10_70 #AT5g59850#cytoplasmic ribosomal protein S15a-like Length = 130 | – | – |
| OS001226.1_s_at (OS001226.1_S_AT) | Similar to RL5_STECL Q26481 *STEYLA CLAVA*. 60S RIBOSOMAL PROTEIN L5. | 68172.m03188#MKM21_30 #AT5g39740#ribosomal protein L5-like Length = 301 | – | – |
| OS001309_at (OS001309_AT) | Similar to gi|3319774|emb|CAA76125.1| TOM7 protein [*Solanum tuberosum*] | 68170.m05144#F22C12_13 #At1g64220#hypothetical protein Length = 77 | – | – |
| OS001396_at (OS001396_AT) | Similar to gi|5123547|emb|CAB45313.1| putative protein [*Arabidopsis thaliana*] | 68170.m05998#F3N23_41 #At1g73010#hypothetical protein Length = 295 | – | – |
| OS001483.1_at (OS001483.1_AT) | Similar to gi|6957515|gb|AAF32437.1| unknown protein [*Arabidopsis thaliana*] | 68172.m00810#T5E8_310 #AT5g09510#ribosomal protein S15-like Length = 152 | – | – |
| OS001563.1_at (OS001563.1_AT) | Similar to gi|1215812|dbj|BAA07369.1| probenazole-inducible protein PBZ1 [*Oryza sativa*] | no_hits | – | – |

TABLE 5-continued

Table 5 shows 339 rice probesets corresponding to rice genes induced by pathogen infection

| ProbeSet | 1. Description | *Arabidopsis* Match | Ps | Bc |
|---|---|---|---|---|
| OS001768.1_at (OS001768.1_AT) | Similar to SAHH_WHEAT P32112 *TRITICUM AESTIVUM* (WHEAT). ADENOSYLHOMOCYSTEINASE (EC 3.3.1.1) (S-ADENOSYL-L-HOMOCYSTEINEHYDROLASE) (ADOHCYASE). | 68173.m02341#MYM9_15 #AT3g23810#S-adenosyl-L-homocysteinas, putative Length = 485 | - | - |
| OS001855_at (OS001855_AT) | Similar to CHMT_MAIZE Q06509 *ZEA MAYS* (MAIZE). BISPECIFIC CAFFEIC ACID/5-HYDROXYFERULIC ACID O-METHYLTRANSFERASE(EC 2.1.1.—). | 68172.m04708#K18G13_3 #AT5g54160#O-methyltransferase Length = 363 | - | - |
| OS001875.1_at (OS001875.1_AT) | Similar to gi|4581163|gb|AAD24646.1|AC006220_2 unknown protein [*Arabidopsis thaliana*] | 51595.m08940#T20G20.3 #At2g05620#unknown protein # Length = 133 | - | - |
| OS001915_at (OS001915_AT) | Similar to gi|8920581|gb|AAF81303.1|AC027656_20 Contains similarity to a hypothetical protein F13M23.30 gi|7485455 from *Arabidopsis thaliana* BAC F13M23 gb|AL035523. | 68172.m04314#MXI22_12 #AT5g50400#putative protein Length = 529 | - | - |
| OS002059.1_at (OS002059.1_AT) | Similar to gi|3264598|gb|AAC24570.1|trypsin inhibitor [*Zea mays*] | 68172.m03068#MBB18_10 #AT5g38560#putative protein Length = 681 | - | - |
| OS002144_f_at (OS002144_F_AT) | Similar to RL12_CHLRE P50884 *CHLAMYDOMONAS REINHARDTII*. 60S RIBOSOMAL PROTEIN L12 (FRAGMENT). | 51595.m11847#T2N18.5 #At2g37190#60S ribosomal protein L12 # Length = 166 | - | - |
| OS002484_f_at (OS002484_F_AT) | Similar to gi|4097549|gb|AAD09508.1|ATFP4 [*Arabidopsis thaliana*] | 68173.m00678#MLP3_5 #AT3g07600#unknown protein Length = 157 | - | - |
| OS002493.1_at (OS002493.1_AT) | Similar to gi|710626|dbj|BAA06384.1|ERD15 protein [*Arabidopsis thaliana*] | 51595.m12267#T26J13.2 #At2g41430#dehydration-induced protein (ERD15) identical to GB: D30719 Length = 163 | - | - |
| OS002532.1_at (OS002532.1_AT) | Similar to gi|6735366|emb|CAB68187.1| putative protein [*Arabidopsis thaliana*] | 68173.m04920#F14P22_80 #AT3g58490#putative protein Length = 416 | - | - |
| OS002675.1_at (OS002675.1_AT) | Similar to gi|483431|dbj|BAA05059.1|cyc07 [*Oryza sativa*] | 68164.m03291#T4L20_250 #AT4g34670#Putative S-phase-specific ribosomal protein Length = 262 | - | - |
| OS002683_at (OS002683_AT) | Similar to gi|1617121|emb|CAA69915.1| subtilisin-chymotrypsin inhibitor 2 [*Hordeum vulgare*] | no_hits | - | - |
| OS002708_at (OS002708_AT) | Similar to gi|5281058|emb|CAB46005.1| hypothetical protein [*Arabidopsis thaliana*] | 68172.m01243#F18O22_210 #AT5g14420#putative protein Length = 468 | - | - |
| OS002811.1_at (OS002811.1_AT) | Similar to gi|7543909|emb|CAB87149.1| transaldolase-like protein [*Arabidopsis thaliana*] | 68172.m01142#T22N19_70 #AT5g13420#transaldolase-like protein Length = 438 | - | - |
| OS002953.1_at (OS002953.1_AT) | Similar to gi|168550|gb|AAA18554.1| putative. similar to anthranilate synthase component II | 68170.m02317#F4F7_7 #At1g25220#hypothetical protein Length = 276 | - | - |
| OS003029.1_at (OS003029.1_AT) | Similar to gi|5042456|gb|AAD38293.1|AC007789_19 putative pathogenesis related protein [*Oryza sativa*] | 68170.m06564#F9K20_18 #At1g78780#hypothetical protein Length = 276 | - | - |
| OS003145.1_i_at (OS003145.1_I_AT) | Similar to gi|7487386|pir||T13007 hypothetical protein T24C20.60 - *Arabidopsis thaliana* | 68173.m03889#T24C20_60 #AT3g48180#hypothetical protein Length = 77 | - | - |
| OS003374_s_at (OS003374_S_AT) | Similar to SYD_HALSA O07683 *HALOBACTERIUM SALINARIUM*. ASPARTYL-TRNA SYNTHETASE (EC 6.1.1.12) (ASPARTATE--TRNA LIGASE)(ASPRS). | 68164.m02943#F6E21_100 #AT4g31180#aspartate--tRNA ligase-like protein Length = 558 | - | - |

TABLE 5-continued

Table 5 shows 339 rice probesets corresponding to rice genes induced by pathogen infection

| ProbeSet | 1. Description | *Arabidopsis* Match | Ps | Bc |
|---|---|---|---|---|
| OS003712_at (OS003712_AT) | Similar to gi\|2801538\|gb\|AAB97367.1\|harpin induced gene 1 homolog [*Oryza sativa*] | 51595.m11733#F11F19.11 #At2g35980#hin1-like protein #similar to harpin-induced protein hin1 from tobacco Length = 227 | – | – |
| OS003764_f_at (OS003764_F_AT) | Similar to gi\|687638\|gb\|AAA80335.1\| metallothionein-like protein | no_hits | – | – |
| OS003780_at (OS003780_AT) | Similar to gi\|5734627\|dbj\|BAA83358.1\| hypothetical protein [*Oryza sativa*] | 68173.m04200#F24M12_330 #AT3g51290#putative protein Length = 602 | – | – |
| OS003819_i_at (OS003819_I_AT) | Similar to gi\|9049425\|dbj\|BAA99380.1\|EST AU092803(C53725) corresponds to a region of the predicted gene.~Similar to *Zea mays* Bowman-Birk proteinase inhibitors WIP1 precursor (X71396) [*Oryza sativa*] | no_bits | – | – |
| OS003835_s_at (OS003835_S_AT) | Similar to gi\|553043\|gb\|AAA32823.1\| isocitrate lyase | 68173.m02117#MSD21_3 #AT3g21720#putative isocitrate lyase Length = 573 | – | – |
| OS003892_at (OS003892_AT) | Similar to gi\|4038471\|gb\|AAC97381.1\|40S ribosomal protein S27 homolog [*Zea mays*] | 68173.m05182#T27I15_200 #AT3g61110#ribosomal protein S27 Length = 86 | – | – |
| OS003958_at (OS003958_AT) | Similar to gi\|9293917\|dbj\|BAB01820.1\| emb\|CAB72194.1~gene_id: MXO21.9 ~similar to unknown protein [*Arabidopsis thaliana*] | 68173.m02908#MXO21_9 #AT3g29240#unknown protein Length = 317 | – | – |
| OS003964_f_at (OS003964_F_AT) | Similar to RL37_LEIIN P39094 *LEISHMANIA INFANTUM*, AND *LEISHMANIA DONOVANI*. 60S RIBOSOMAL PROTEIN L37. | 68173.m01519#MSL1_12 #AT3g16080#putative ribosomal protein Length = 142 | – | – |
| OS004006_s_at (OS004006_S_AT) | Similar to RS15_HUMAN P11174 *HOMO SAPIENS* (HUMAN), *MUS MUSCULUS* (MOUSE), *RATTUS NORVEGICUS* (RAT), *MESOCRICETUS AURATUS* (GOLDEN HAMSTER), AND *GALLUS GALLUS* (CHICKEN). 40S RIBOSOMAL PROTEIN S15 (RIG PROTEIN). | 68172.m00810#T5E8_310 #AT5g09510#ribosomal protein S15-like Length = 152 | – | – |
| OS004086.1_at (OS004086.1_AT) | Similar to gi\|2738248\|gb\|AAC50037.1\| cobalamin-independent methionine synthase [*Arabidopsis thaliana*] | 68172.m01594#MPI7_60 #AT5g17920#5-methyltetrahydropteroyltriglutamate--homocysteine S-methyltransferase Length = 765 | – | – |
| OS004128.1_at (OS004128.1_AT) | Similar to gi\|2245138\|emb\|CAB10559.1\| hypothetical protein [*Arabidopsis thaliana*] | 68164.m01610#d14930w #AT4g17790#hypothetical protein Length = 264 | – | – |
| OS004156.1_f_at (OS004156.1_F_AT) | Similar to gi\|1173200\|sp\|P42036\|RS14_ARATH 40S RIBOSOMAL PROTEIN S14 | 68173.m04329#F22O6_40 #AT3g52580#putative ribosomal protein S14 Length = 150 | – | – |
| OS004187.1_at (OS004187.1_AT) | Similar to gi\|6983871\|dbj\|BAA90806.1\|ESTs C26000(C11448), AU082130(C11448) correspond to a region of the predicted gene.; Similar to mRNA for zinc-finger protein (Z36749) [*Oryza sativa*] | no_hits | – | – |
| OS004223.1_f_at (OS004223.1_F_AT) | Similar to gi\|457682\|dbj\|BAA04961.1\|possible scar protein coding sequence [*Oryza sativa*] | 68172.m05152#mqj2_10 #AT5g58420#ribosomal protein S4-like Length = 262 | – | – |
| OS004260.1_s_at (OS004260.1_S_AT) | Similar to gi\|3747048\|gb\|AAC64165.1\| methionine synthase [*Zea mays*] | 68172.m01594#MPI7_60 #AT5g17920#5-methyltetrahydropteroyltriglutamate--homocysteine S-methyltransferase Length = 765 | – | – |

TABLE 5-continued

Table 5 shows 339 rice probesets corresponding to rice genes induced by pathogen infection

| ProbeSet | 1. Description | *Arabidopsis* Match | Ps | Bc |
|---|---|---|---|---|
| OS004263.1__at (OS004263.1__AT) | Similar to gi\|1778686\|dbj\|BAA13417.1\| precursor ferredoxin-NADP+ oxidoreductase [*Oryza sativa*] | 68170.m02767#F26G16__5 #At1g30510#ferrodoxin NADP oxidoreductase, putative Length = 537 | – | – |
| OS004321.1__at (OS004321.1__AT) | Similar to gi\|7634680\|dbj\|BAA94795.1\|S-adenosyl-L-methionine: L-methionine S-methyltransferase [*Hordeum vulgare*] | 68172.m04253#K21G20__2 #AT5g49810#methionine S-methyltransferase (gb\|AAD49574.1) Length = 1071 | – | – |
| OS004660.1__at (OS004660.1__AT) | Similar to gi\|22470\|emb\|CAA39438.1\| ribosomal protein S11 [*Zea mays*] | 68172.m02081#MRO11__22 #AT5g23740#40S ribosomal protein S11 Length = 159 | – | – |
| OS004858.1__at (OS004858.1__AT) | Similar to gi\|5802606\|gb\|AAD51733.1\|AF174486__1 methylenetetrahydrofolate reductase [*Zea mays*] | 51595.m12536#F6E13.29 #At2g44160#putative methylenetetrahydrofolate reductase # Length = 606 | – | – |
| OS004884__at (OS004884__AT) | Similar to gi\|4262241\|gb\|AAD14534.1\| unknown protein [*Arabidopsis thaliana*] | 68172.m02995#K22F20__80 #AT5g37840#putative protein Length = 214 | – | – |
| OS005003__f_at (OS005003__F__AT) | Similar to gi\|1710553\|sp\|P51426\|RL39__ORYSA 60S RIBOSOMAL PROTEIN L39 | 51595.m10682#T22F11__20 #At2g25210#60S ribosomal protein L39 # Length = 44 | – | – |
| OS005111__f_at (OS005111__F__AT) | Similar to RL32__ARATH P49211 *ARABIDOPSIS THALIANA* (MOUSE-EAR CRESS). 60S RIBOSOMAL PROTEIN L32 (FRAGMENT). | 68164.m01640#F15J5__70 #AT4g18100#ribosomal protein L32-like protein Length = 133 | – | – |
| OS005182__at (OS005182__AT) | Similar to gi\|2267597\|gb\|AAB63591.1\|10 kDa chaperonin [*Oryza sativa*] | 68170.m01363#T15D22__6 #At1g14980#chaperonin CPN10 Length = 97 | – | – |
| OS005203__s_at (OS005203__S__AT) | Similar to gi\|2459420\|gb\|AAB80655.1\|60S ribosomal protein L23 [*Arabidopsis thaliana*] | 68173.m00346#T27C4__4 #AT3g04400#ribosomal protein L17, putative Length = 140 | – | – |
| OS005226__at (OS005226__AT) | Similar to gi\|3885884\|gb\|AAC78102.1\|60S ribosomal protein L21 [*Oryza sativa*] | 68170.m04642#F12K22__19 #At1g57860#hypothetical protein Length = 164 | – | – |
| OS005280__i_at (OS005280__I__AT) | Similar to gi\|6006889\|gb\|AAF00664.1\|AC008153__16 putative small nuclear ribonucleoprotein polypeptide G [*Arabidopsis thaliana*] | 51595.m10555#T29E15__13 #At2g23930#putative small nuclear ribonucleoprotein G # Length = 80 | – | – |
| OS005291__f_at (OS005291__F__AT) | Similar to RL37__LYCES P49212 *LYCOPERSICON ESCULENTUM* (TOMATO). 60S RIBOSOMAL PROTEIN L37 (FRAGMENT). | 68170.m04187#F19K6__12 #At1g52300#60S ribosomal protein L37, putative Length = 95 | – | – |
| OS005312__f_at (OS005312__F__AT) | Similar to gi\|5106775\|gb\|AAD39838.1\|AF067732__1 ribosomal protein S12 [*Hordeum vulgare*] | 51595.m11356#F22D22__19 #At2g32060#40S ribosomal protein S12 # Length = 144 | – | – |
| OS005329__s_at (OS005329__S__AT) | Similar to gi\|7549645\|gb\|AAF63830.1\| ribosomal protein L29, putative [*Arabidopsis thaliana*] | 68173.m00588#F3E22__16 #AT3g06700#ribosomal protein L29, putative Length = 61 | – | – |
| OS005352__f_at (OS005352__F__AT) | Similar to gi\|7441100\|pir\|\|T02526 ribosomal protein L36, cytosolic - *Arabidopsis thaliana* | 68173.m04445#F5K20__40 #AT3g53740#60S RIBOSOMAL PROTEIN L36 homolog Length = 112 | – | – |
| OS005370.1__at (OS005370.1__AT) | Similar to gi\|303855\|dbj\|BAA02156.1\| ribosomal protein L7A [*Oryza sativa*] | 51595.m12876#T30B22__8 #At2g47610#60S ribosomal protein L7A # Length = 257 | – | – |
| OS005401__at (OS005401__AT) | Similar to gi\|2792202\|gb\|AAB96976.1\|NBS-LRR type resistance protein [*Hordeum vulgare*] | 68164.m02435#F20B18__200 #AT4g26090#disease resistance protein RPS2 Length = 909 | – | – |
| OS005481__s_at (OS005481__S__AT) | Similar to gi\|6729525\|emb\|CAB67610.1\| putative protein [*Arabidopsis thaliana*] | 68170.m04642#F12K22__19 #At1g57860#hypothetical protein Length = 164 | – | – |

TABLE 5-continued

Table 5 shows 339 rice probesets corresponding to rice genes induced by pathogen infection

| ProbeSet | 1. Description | *Arabidopsis* Match | Ps | Bc |
|---|---|---|---|---|
| OS005483_at (OS005483_AT) | Similar to gi\|9229963\|dbj\|BAB00654.1\| gene_id: MGD8.2~unknown protein [*Arabidopsis thaliana*] | 68173.m01640#MGD8_2 #AT3g17210#unknown protein Length = 109 | – | – |
| OS005528_at (OS005528_AT) | Similar to gi\|6491770\|emb\|CAB61886.1\| ribosomal protein L17 [*Lycopersicon esculentum*] | 68173.m00346#T27C4_4 #AT3g04400#ribosomal protein L17, putative Length = 140 | – | – |
| OS005531_at (OS005531_AT) | Similar to gi\|9294484\|dbj\|BAB02703.1\| gb\|AAF02142.1~gene_id: MEB5.2~similar to unknown protein [*Arabidopsis thaliana*] | 68173.m01701#MEB5_2 #AT3g17800#unknown protein Length = 421 | – | – |
| OS005541_at (OS005541_AT) | Similar to gi\|6682234\|gb\|AAF23286.1\|AC016661_11 putative ankyrin [*Arabidopsis thaliana*] | 68173.m00837#F11F8_13 #AT3g09550#putative ankyrin Length = 436 | – | – |
| OS005586_f_at (OS005586_F_AT) | Similar to gi\|4768988\|gb\|AAD29707.1\|AF140494_1 60S ribosomal protein [*Oryza sativa*] | 68164.m01640#F15J5_70 #AT4g18100#ribosomal protein L32-like protein Length = 133 | – | – |
| OS005634.1_at (OS005634.1_AT) | Similar to gi\|8886324\|gb\|AAF80449.1\|AF161718_1 Sec61p [*Triticum aestivum*] | 51595.m11562#F13P17.9 #At2g34250#putative protein transport protein SEC61 alpha subunit # Length = 475 | – | – |
| OS005645_f_at (OS005645_F_AT) | Similar to R372_YEAST P41056 *SACCHAROMYCES CEREVISIAE* (BAKER S YEAST). 60S RIBOSOMAL PROTEIN L37B (YL37) (RP47). | 68170.m06121#F1O17_6 #At1g74270#putative ribosomal protein Length = 112 | – | – |
| OS005652.1_at (OS005652.1_AT) | Similar to gi\|1174162\|gb\|AAA86642.1\| ubiquitin-conjugating enzyme | 68173.m04858#T10K17_80 #AT3g57870#E2 ubiquitin-conjugating-like enzyme Ahus5 Length = 160 | – | – |
| OS005680_s_at (OS005680_S_AT) | Similar to SYN_SALTI Q56112 *SALMONELLA TYPHI.* ASPARAGINYL-TRNA SYNTHETASE (EC 6.1.1.22) (ASPARAGINE--TRNA LIGASE)(ASNRS) (FRAGMENT). | 68172.m04972#MIK19_13 #AT5g56680#SYNC1 protein (gb\|AAD46681.1) Length = 572 | – | – |
| OS005704_f_at (OS005704_F_AT) | Similar to RL36_CAEEL P49181 *CAENORHABDITIS ELEGANS.* PROBABLE 60S RIBOSOMAL PROTEIN L36. | 51595.m11888#F13M22_10 #At2g37600#60S ribosomal protein L36 # Length = 113 | – | – |
| OS005898.1_at (OS005898.1_AT) | Similar to gi\|6856560\|gb\|AAF29978.1\|AF188065_1 isopentenyl pyrophosphate:dimethyllallyl pyrophosphate isomerase [*Oryza sativa*] | 68173.m00182#F13E7_28 #AT3g02780#isopentenyl diphosphate:dimethylallyl diphosphate isomerase (IPP2) Length = 284 | – | – |
| OS006101_f_at (OS006101_F_AT) | Similar to gi\|4263712\|gb\|AAD15398.1\|40S ribosomal protein S12 [*Arabidopsis thaliana*] | 68170.m01455#T24D18_3 #At1g15930# Length = 144 | – | – |
| OS006260.1_at (OS006260.1_AT) | Similar to gi\|3482932\|gb\|AAC33217.1\|AAC33217 Hypothetical protein [*Arabidopsis thaliana*] | 68170.m04626#T8L23_8 #At1g57610#hypothetical protein Length = 289 | – | – |
| OS006436.1_at (OS006436.1_AT) | Similar to RL6_MESCR P34091 *MESEMBRYANTHEMUM CRYSTALLINUM* (COMMON ICE PLANT). 60S RIBOSOMAL PROTEIN L6 (YL16-LIKE). | 68170.m06090#F2P9_8 #At1g74050#putative 60S ribosomal protein L6 Length = 233 | – | – |
| OS006777_r_at (OS006777_R_AT) | Similar to gi\|4185132\|gb\|AAD08935.1\| hypothetical protein [*Arabidopsis thaliana*] | 68164.m02863#F17I23_280 #AT4g30380#blight-associated protein homolog Length = 123 | – | – |
| OS006813.1_i_at (OS006813.1_I_AT) | Similar to gi\|5903034\|gb\|AAD55593.1\|AC008016_3 F6D8.3 [*Arabidopsis thaliana*] | 68170.m04194#F6D8_3 #At1g52720#F6D8.3 Length = 116 | – | – |
| OS007065_at (OS007065_AT) | Similar to gi\|6358781\|gb\|AAF07362.1\|AC010852_3 hypothetical protein [*Arabidopsis thaliana*] | 68170.m00048#F22L4_17 #At1g01490#hypothetical protein Length = 177 | – | – |

TABLE 5-continued

Table 5 shows 339 rice probesets corresponding to rice genes induced by pathogen infection

| ProbeSet | 1. Description | *Arabidopsis* Match | Ps | Bc |
|---|---|---|---|---|
| OS007318.1_s_at (OS007318.1_S_AT) | Similar to COXG_HUMAN P14854 *HOMO SAPIENS* (HUMAN). CYTOCHROME C OXIDASE POLYPEPTIDE VIB (EC 1.9.3.1) (AED). | 68164.m02631#T13J8_170 #AT4g28060#putative protein Length = 164 | – | – |
| OS007548.1_at (OS007548.1_AT) | Similar to MPCP_YEAST P23641 *SACCHAROMYCES CEREVISIAE* (BAKER S YEAST). MITOCHONDRIAL PHOSPHATE CARRIER PROTEIN (PHOSPHATE TRANSPORT PROTEIN)(MITOCHONDRIAL IMPORT RECEPTOR) (P32). | 68172.m01205#MUA22_4 #AT5g14040#mitochondrial phosphate translocator Length = 375 | – | – |
| OS007568.1_at (OS007568.1_AT) | Similar to SR14_MOUSE P16254 *MUS MUSCULUS* (MOUSE). SIGNAL RECOGNITION PARTICLE 14 KD PROTEIN (SRP14). | 51595.m12484#F18O19.25 #At2g43640#putative signal recognition particle protein 14 kD, ATSRP14 # Length = 121 | – | – |
| OS007576_at (OS007576_AT) | Similar to RL29_HALMA P10971 P22526 *HALOARCULA MARISMORTUI* (*HALOBACTERIUM MARISMORTUI*). 50S RIBOSOMAL PROTEIN L29 (HMAL29) (HL33). | 68173.m00832#F11F8_7 #AT3g09500#putative 60S ribosomal protein L35 Length = 123 | – | – |
| OS007607.1_at (OS007607.1_AT) | Similar to gi|7109467|gb|AAF36731.1|putative 60S ribosomal protein L6 [*Arabidopsis thaliana*] | 68170.m06090#F2P9_8 #At1g74050#putative 60S ribosomal protein L6 Length = 233 | – | – |
| OS007627.1_s_at (OS007627.1_S_AT) | Similar to gi|4056502|gb|AAC98068.1|40S ribosomal protein S5 [*Arabidopsis thaliana*] | 51595.m11855#F3G5.6# At2g37270#40S ribosomal protein S5 #identical to GP: 3043428 Length = 207 | – | – |
| OS007629.1_s_at (OS007629.1_S_AT) | Similar to gi|3915826|sp|P49625|RL5_ORYSA 60S RIBOSOMAL PROTEIN L5 | 68173.m02503#MWL2_14 #AT3g25520#ribosomal protein, putative Length = 190 | – | – |
| OS007672_f_at (OS007672_F_AT) | Similar to RS6X_SULSO P55858 *SULFOLOBUS SOLFATARICUS*. 30S RIBOSOMAL PROTEIN HS6-LIKE. | 51595.m11356#F22D22.19 #At2g32060#40S ribosomal protein S12 # Length = 144 | – | – |
| OS007941_at (OS007941_AT) | Similar to CP72_CATRO Q05047 *CATHARANTHUS ROSEUS* (ROSY PERIWINKLE) (MADAGASCAR PERIWINKLE). CYTOCHROME P450 LXXII (EC 1.14.14.1) (PROBABLE GERANIOL-10-HYDROXYLASE) (GE10H). | 51595.m12811#F14M4.22 #At2g46950#putative cytochrome P450 # Length = 517 | – | – |
| OS008005.1_at (OS008005.1_AT) | Similar to YWAC_BACSU P39583 *BACILLUS SUBTILIS*. HYPOTHETICAL 24.6 KD PROTEIN IN DAE-TYRZ INTERGENIC REGION. | 68173.m01667#MKP6_2 #AT3g17470#hypothetical protein Length = 570 | – | – |
| OS008432_i_at (OS008432_I_AT) | Similar to gi|3128215|gb|AAC26695.1| hypothetical protein [*Arabidopsis thaliana*] | 68172.m01123#T31B5_40 #AT5g13220#putative protein Length = 230 | – | – |
| OS008771.1_at (OS008771.1_AT) | Similar to gi|6714427|gb|AAF26115.1|AC012328_18 hypothetical protein [*Arabidopsis thaliana*] | 68173.m01811#MVE11_22 #AT3g18830#sugar transport, putative Length = 539 | – | – |
| OS008780_at (OS008780_AT) | Similar to gi|6006855|gb|AAF00631.1|AC009540_8 hypothetical protein [*Arabidopsis thaliana*] | 68173.m00293#F20H23_8 #AT3g03870#hypothetical protein Length = 266 | – | – |
| OS008982_i_at (OS008982_I_AT) | Similar to gi|391875|dbj|BAA02157.1|40S subunit ribosomal protein [*Oryza sativa*] | 68173.m03574#F14D17_100 #AT3g45030#40S ribsomomal protein Length = 117 | – | – |
| OS009019_at (OS009019_AT) | Similar to gi|3318615|dbj|BAA31584.1| mitochondrial phosphate transporter [*Oryza sativa*] | 68172.m01205#MUA22_4 #AT5g14040#mitochondrial phosphate translocator Length = 375 | – | – |

TABLE 5-continued

Table 5 shows 339 rice probesets corresponding to rice genes induced by pathogen infection

| ProbeSet | 1. Description | *Arabidopsis* Match | Ps | Bc |
|---|---|---|---|---|
| OS009093_r_at (OS009093_R_AT) | Similar to gi\|6815066\|dbj\|BAA90353.1\|EST C26866(C50282) corresponds to a region of the predicted gene.; hypothetical protein [*Oryza sativa*] | no_hits | – | – |
| OS009344_at (OS00934_AT) | Similar to gi\|6714289\|gb\|AAF25985.1\|AC013354_4 F15H18.13 [*Arabidopsis thaliana*] | 68172.m01023#T22P22_40 #AT5g11650#lysophospholipase-like protein Length = 390 | – | – |
| OS009388.1_at (OS009388.1_AT) | Similar to gi\|4190952\|dbj\|BAA74434.1\|similar to hsr203J [*Lycopersicon esculentum*] | 68172.m00570#F15M7_10 #AT5g06570#putative protein Length = 329 | – | – |
| OS009436.1_at (OS009436.1_AT) | Similar to gi\|8777444\|dbj\|BAA97034.1\| gb\|AAD55473.1~gene_id: MHM17.18 ~similar to unknown protein [*Arabidopsis thaliana*] | 68172.m05011#MHM17_18 #AT5g57040#putative protein Length = 197 | – | – |
| OS009475_r_at (OS009475_R_AT) | Similar to gi\|4468997\|emb\|CAB38311.1\| putative protein [*Arabidopsis thaliana*] | no_hits | – | – |
| OS009506_f_at (OS009506_F_FAT) | Similar to gi\|2244917\|emb\|CAB10339.1\| hypothetical protein [*Arabidopsis thaliana*] | 68164.m01390#d13845w #AT4g15610#hypothetical protein Length = 146 | – | – |
| OS009555_i_at (OS009555_I_AT) | Similar to gi\|7269847\|emb\|CAB79706.1\| putative protein [*Arabidopsis thaliana*] | 68164.m02773#F17A13_300 #AT4g29480#putative protein Length = 122 | – | – |
| OS009588_s_at (OS009588_S_AT) | Similar to gi\|6523052\|emb\|CAB62319.1\| putative protein [*Arabidopsis thaliana*] | 68170.m03194#T32G9_27 #At1g35190#hyoscyamine 6-dioxygenase hydroxylase, putative Length = 329 | – | – |
| OS009622_at (OS009622_AT) | Similar to gi\|3123279\|sp\|P49206\|RS26_ARATH 40S RIBOSOMAL PROTEIN S26 | 68173.m04705#F18O21_300 #AT3g56340#40S ribosomal protein S26 homolog Length = 130 | – | – |
| OS009645_at (OS009645_AT) | Similar to gi\|6633821\|gb\|AAF19680.1\|AC009519_14 F1N19.23 [*Arabidopsis thaliana*] | 68170.m05207#F1N19_22 #At1g64660#methionine/ cystathionine gamma lyase, putative Length = 441 | – | – |
| OS009647_f_at (OS009647_F_AT) | Similar to gi\|5734753\|gb\|AAD50018.1\|AC007651_13 Hypothetical Protein [*Arabidopsis thaliana*] | no_hits | – | – |
| OS009885.1_at (OS009885.1_AT) | Similar to RS22_YEAST P04648 *SACCHAROMYCES CEREVISIAE* (BAKER S YEAST). 40S RIBOSOMAL PROTEIN S22 (YS24) (YP58). | 68172.m05295#mmn10_70 #AT5g59850#cytoplasmic ribosomal protein S15a-like Length = 130 | – | – |
| OS010185_f_at (OS010185_F_AT) | Similar to gi\|2244869\|emb\|CAB10291.1\| hypothetical protein [*Arabidopsis thaliana*] | 68164.m03787#T19P19_110 #AT4g39720#putative protein Length = 290 | – | – |
| OS010771_s_at (OS010771_S_AT) | Similar to SPSI_BACSU P39629 *BACILLUS SUBTILIS*. SPORE COAT POLYSACCHARIDE BIOSYNTHESIS PROTEIN SPSI. | 68173.m04630#T22E16_250 #AT3g55590#mannose-1-phosphate guanylyltransferase-like protein Length = 364 | – | – |
| OS010844_f_at (OS010844_F_AT) | Similar to SCP_NERDI P04571 *NEREIS DIVERSICOLOR* (SANDWORM) (HEDISTE DIVERSICOLOR). SARCOPLASMIC CALCIUM-BINDING PROTEIN (SCP). | 68173.m01667#MKP6_2 #AT3g17470#hypothetical protein Length = 570 | – | – |
| OS010906_at (OS010906_AT) | Similar to UCR7_KLULA P49345 *KLUYVEROMYCES LACTIS* (YEAST). UBIQUINOL-CYTOCHROME C REDUCTASE COMPLEX 14 KD PROTEIN (EC 1.10.2.2)(COMPLEX III SUBUNIT VII). | 68172.m02275#F18G18_190 190#AT5g25450#ubiquinol--cytochrome-c reductase-like protein Length = 122 | – | – |
| OS010991.1_at (OS010991.1_AT) | Similar to gi\|8051712\|dbj\|BAA96091.1\|sodium sulfate or dicarboxylate transporter [*Arabidopsis thaliana*] | 68172.m04015#MNJ7_15 #AT5g47560#sodium-dicarboxylate cotransporter-like Length = 462 | – | – |

TABLE 5-continued

Table 5 shows 339 rice probesets corresponding to rice genes induced by pathogen infection

| ProbeSet | 1. Description | *Arabidopsis* Match | Ps | Bc |
|---|---|---|---|---|
| OS011019_at (OS011019_AT) | Similar to YSOD_SULAC P37820 *SULFOLOBUS ACIDOCALDARIUS*. HYPOTHETICAL PROTEIN IN SOD 3 REGION (FRAGMENT). | 51595.m12103#T517.7# At2g39770#putative GDP-mannose pyrophosphorylase # Length = 361 | – | – |
| OS011054_r_at (OS011054_R_AT) | Similar to gi|8979723|emb|CAB96844.1| putative protein [*Arabidopsis thaliana*] | 68172.m00948#T30N20_160 #AT5g10890#putative protein Length = 295 | – | – |
| OS011109_r_at (OS011109_R_AT) | Similar toYGRC_BACFI Q45132 *BACILLUS FIRMUS*. HYPOTHETICAL 8.8 KD PROTEIN IN GRPA-GRPB INTERGENIC REGION. | no_hits | – | – |
| OS011227.1_at (OS011227.1_AT) | Similar to gi|1762586|gb|AAB39547.1| polygalacturonase isoenzyme 1 beta subunit | 68170.m05766#F17O7_9 #At1g70370#hypothetical protein Length = 626 | – | – |
| OS011273.1_at (OS011273.1_AT) | Similar to gi|7406399|emb|CAB85509.1| putative protein [*Arabidopsis thaliana*] | no_hits | – | – |
| OS011767_s_at (0S011767_S_AT) | Similar to gi|6016699|gb|AAF01526.1|AC0099 91_22 putative 60S ribosomal protein L37a [*Arabidopsis thaliana*] | 68173.m00979#F9F8_23 #AT3g10950#putative 60S ribosomal protein L37a Length = 92 | – | – |
| OS011841_r_at (OS011841_R_AT) | Similar to gi|8953388|emb|CAB96661.1|HY5 [*Arabidopsis thaliana*] | 68172.m00985#F2I11_150 #AT5g11260#HY5 Length = 168 | – | – |
| OS011954_at (OS011954_AT) | Similar to gi|2130118|pir||S67993 amylogenin-maize (fragments) | 68173.m00127#F14P3_12 #AT3g02230#reversibly glycosylated polypeptide-1 Length = 357 | – | – |
| OS012036.1_at (OS012036.1_AT) | Similar to FABG_CUPLA P28643 *CUPHEA LANCEOLATA*. 3-OXOACYL-[ACYL-CARRIER PROTEIN] REDUCTASE PRECURSOR (EC 1.1.1.100)(3-KETOACYL-ACYL CARRIER PROTEIN REDUCTASE). | 68170.m02281#F21J9_300 #At1g24360#putative 3-oxoacyl [acyl-carrier protein] reductase Length = 308 | – | – |
| OS012082_at (OS012082_AT) | Similar to RL22_SCHPO Q09668 O13694 *SCHIZOSACCHAROMYCES POMBE* (FISSION YEAST). 60S RIBOSOMAL PROTEIN L22. | 68173.m00466#F18C1_17 #AT3g05560#putative 60S ribosomal protein L22 Length = 124 | – | – |
| OS012104_at (OS012104_AT) | Similar to FABG_PERAE P27583 *PERSEA AMERICANA* (AVOCADO). 3-OXOACYL-[ACYL-CARRIER PROTEIN] REDUCTASE (EC 1.1.1.100) (3-KETOACYL-ACYL CARRIER PROTEIN REDUCTASE) (FRAGMENTS). | no_hits | – | – |
| OS012243_s_at (OS012243_S_AT) | Similar to gi|2829913|gb|AAC00621.1|putative carboxyphosphoenolpyruvate mutase [*Arabidopsis thaliana*] | 68170.m01992#F24J8_19 #At1g21440#hypothetical protein Length = 317 | – | – |
| OS012265_at (OS012265_AT) | Similar to gi|8809594|dbj|BAA97145.1| gene_id: MNB8.11~unknown protein [*Arabidopsis thaliana*] | 68172.m04592#MNB8_11 #AT5g53050#unknown protein Length = 438 | – | – |
| OS012282_at (OS012282_AT) | Similar to gi|2772934|gb|AAD03489.1|C-8,7 sterol isomerase; aSI1 [*Arabidopsis thaliana*] | 68170.m01866#T20H2_16 #At1g20050#C-8,7 sterol isomerase Length = 223 | – | – |
| OS012349_at (OS012349_AT) | Similar to gi|3859607|gb|AAC72873.1|contains similarity to cysteine proteases (Pfam: PF00112, E = .21, N = 1) [*Arabidopsis thaliana*] | 68164.m00161#T15B16_17-01#AT4g01610#putative cysteine protease Length = 129 | – | – |
| OS012594.1_at (OS012594.1_AT) | Similar to gi|2286121|gb|AAC12786.1|sec14 like protein [*Oryza sativa*] | 68170.m00062#T1N6_1 #At1g01630#polyphosphoinositide binding protein, putative Length = 255 | – | – |
| OS012641.1_f_at (OS012641.1_F_AT) | Similar to gi|3319776|emb|CAA07600.1|seryl-tRNA synthetase [*Zea mays*] | 68172.m02447#F21A20_180 #AT5g27470#seryl-tRNA synthetase Length = 451 | – | – |

TABLE 5-continued

Table 5 shows 339 rice probesets corresponding to rice genes induced by pathogen infection

| ProbeSet | 1. Description | *Arabidopsis* Match | Ps | Bc |
|---|---|---|---|---|
| OS012812_s_at (OS012812_S_AT) | Similar to R18E_METJA P54022 *METHANOCOCCUS JANNASCHII.* 50S RIBOSOMAL PROTEIN L18E. | 68172.m02485#F14123__10 #AT5g27850#60S ribosomal protein-like Length = 187 | − | − |
| OS012817.1_at (OS012817.1_AT) | Similar to gi\|224647\|prf\|\|1109273A nodulin 35 [*Glycine max*] | 51595.m10782#T1D16.13 #At2g26230#putative uricase subunit #similar to nodulin-35; identical to GB: Y11120 Length = 309 | − | − |
| OS012858_s_at (OS012858_S_AT) | Similar to TRPG_PORPU P51362 *PORPHYRA PURPUREA.* ANTHRANILATE SYNTHASE COMPONENT II (EC 4.1.3.27) (GLUTAMINE AMIDO-TRANSFERASE). | 68170.m02312#F4F7__2 #At1g25170#hypothetical protein Length = 469 | − | − |
| OS013164_f_at (OS013164_F_AT) | Similar to gi\|7268795\|emb\|CAB79000.1\| hypothetical protein [*Arabidopsis thaliana*] | 68164.m03787#T19P19__110 #AT4g39720#putative protein Length = 290 | − | − |
| OS013280_f_at (OS013280_F_AT) | Similar to gi\|2827654\|emb\|CAA16608.1\| hypothetical protein [*Arabidopsis thaliana*] | 68164.m03787#T19P19__110 #AT4g39720#putative protein Length = 290 | − | − |
| OS013382.1_at (OS013382.1_AT) | Similar to gi\|7576892\|gb\|AAF64042.1\|AF229813__1 fatty acid alpha-oxidase [*Oryza sativa*] | 68173.m00043#T13O15__6 #AT3g01420#feebly-like protein Length = 639 | − | − |
| OS013473_at (OS013473_AT) | Similar to CM4T_STRPE Q06528 *STREPTOMYCES PEUCETIUS.* CARMINOMYCIN 4-O-METHYLTRANSFERASE (EC 2.1.1.—) (COMT). | 68164.m03340#T12J5__30 #AT4g35160#O-methyltransferase-like protein Length = 382 | − | − |
| OS013503.1_at (OS013503.1_AT) | Similar to gi\|4959322\|gb\|AAD34319.1\|AF105149__1 kaurene synthase [*Zea mays*] | 68170.m06629#T8K14__12 #At1g79460#hypothetical protein Length = 785 | − | − |
| OS013977_at (OS013977_AT) | Similar to RL1_METVA P15824 *METHANOCOCCUS VANNIELII.* 50S RIBOSOMAL PROTEIN L1 (RIBOSOMAL PROTEIN ML6). | 51595.m10913#F15K20.37 #At2g27530#60S ribosomal protein L10A # Length = 222 | − | − |
| OS013985.1_at (OS013985.1_AT) | Similar to gi\|2191162\|gb\|AAB61048.1\|Similar to threonyl-tRNA synthetase; coded for by *A. thaliana* cDNA R65376 [*Arabidopsis thaliana*] | 68172.m02383#F2P16__90 #AT5g26830#threonyl-tRNA synthetase Length = 676 | − | − |
| OS014023_f_at (OS014023_F_AT) | Similar to SCP_PERVT P04572 *PERINEREIS VANCAURICA TETRADENTATA* (SANDWORM). SARCOPLASMIC CALCIUM-BINDING PROTEIN (SCP). | 68173.m01667#MKP6__2 #AT3g17470#hypothetical protein Length = 570 | − | − |
| OS014260_at (OS014260_AT) | Similar to YG1Q_YEAST P53224 *SACCHAROMYCES CEREVISIAE* (BAKER S YEAST). HYPOTHETICAL 25.2 KD PROTEIN IN ACB1-KSS1 INTERGENIC REGION. | 68172.m03423#MJC20__10 #AT5g42000#putative protein Length = 154 | − | − |
| OS014557.1_at (OS014557.1_AT) | Similar to gi\|3281846\|emb\|CAA07004.1\|late elongated hypocotyl [*Arabidopsis thaliana*] | 68170.m00006#T25K16__6 #At1g01060#DNA-binding protein, putative Length = 645 | − | − |
| OS014713.1_r_at (OS014713.1_R_AT) | Similar to gi\|4262145\|gb\|AAD14445.1\| hypothetical protein [*Arabidopsis thaliana*] | 68170.m05615#F14K14__5 #At1g68840#RAV2 Length = 352 | − | − |
| OS014982_at (OS014982_AT) | Similar to gi\|1041423\|emb\|CAA63139.1\| aminolevulinate dehydratase [*Hordeum vulgare*] | 68170.m05701#T6C23__6 #At1g69740#putative aminolevulinate dehydratase Length = 430 | − | − |
| OS015191_at (OS015191_AT) | Similar to gi\|7209794\|dbj\|BAA92322.1\|protein disulfide isomerase [*Oryza sativa*] | 68170.m02023#F8K7__19 #At1g21750#putative protein disulfide isomerase precursor Length = 501 | − | − |
| OS015333_at (OS015333_AT) | Similar to gi\|7378610\|emb\|CAB83286.1\| adenosine kinase-like protein [*Arabidopsis thaliana*] | 68172.m00230#AT5g03300 #AT5g03300#adenosine kinase-like protein Length = 345 | − | − |

TABLE 5-continued

Table 5 shows 339 rice probesets corresponding to rice genes induced by pathogen infection

| ProbeSet | 1. Description | *Arabidopsis* Match | Ps | Bc |
|---|---|---|---|---|
| OS015607_at (OS015607_AT) | Similar to gi\|5107033\|gb\|AAD39930.1\|AF133708_1 PP2A regulatory subunit [*Arabidopsis thaliana*] | 68172.m04587#MNB8_6 #AT5g53000#PP2A regulatory subunit Length = 413 | – | – |
| OS015683_at (OS015683_AT) | Similar to gi\|4938494\|emb\|CAB43852.1\| putative calcineurin B-like protein [*Arabidopsis thaliana*] | 68172.m04898#MDA7_3 #AT5g55990#calcineurin B-like protein 2 (gb\|AAC26009.1) Length = 226 | – | – |
| OS015740_at (OS015740_AT) | Similar to gi\|8569098\|gb\|AAF76443.1\|AC015445_10 ESTs gb\|F20048, gb\|F20049 come from this gene. [*Arabidopsis thaliana*] | 68170.m03958#F2J10_4 #At1g50020#tubulin alpha-6 chain, putative Length = 209 | – | – |
| OS015950_s_at (OS015950_S_AT) | Similar to PTPN_HUMAN Q16849 Q08319 *HOMO SAPIENS* (HUMAN). PROTEIN-TYROSINE PHOSPHATASE N PRECURSOR (EC 3.1.3.48) (R-PTP-N) (PTPIA-2) (ISLET CELL ANTIGEN 512) (ICA 512) (ISLET CELL AUTOANTIGEN 3). | 68170.m05884#F14O23_21 #At1g71860#protein tyrosine phosphatase Length = 340 | – | – |
| OS015964.1_at (OS015964.1_AT) | Similar to gi\|4760483\|dbj\|BAA77282.1\| monodehydroascorbate reductase [*Oryza sativa*] | 68172.m00269#F17C15_50 #AT5g03630#monodehydroascorbate reductase (NADH)-like protein Length = 437 | – | – |
| OS016225_at (OS016225_AT) | Similar to PRCG_RAT P40307 *RATTUS NORVEGICUS* (RAT). PROTEASOME COMPONENT C7-I (EC 3.4.99.46) (MACROPAIN SUBUNIT C7-I)(MULTICATALYTIC ENDOPEPTIDASE COMPLEX SUBUNIT C7-I). | 68164.m01309#d13440w #AT4g14800#proteasome chain protein Length = 199 | – | – |
| OS016556_s_at (OS016556_S_AT) | Similar to CBP1_HORVU P07519 P07520 *HORDEUM VULGARE* (BARLEY). SERINE CARBOXYPEPTIDASE I PRECURSOR (EC 3.4.16.5) (CARBOXYPEPTIDASEC) (CP-MI). | 68173.m02492#MWL2_3 #AT3g25420#serine carboxypeptidase, putative Length = 505 | – | – |
| OS016734_at (OS016734_AT) | Similar to gi\|9369397\|gb\|AAF87145.1\|AC002423_10 T23E23.20 [*Arabidopsis thaliana*] | 68170.m02251#T23E23_11 #At1g24050#unknown protein Length = 173 | – | – |
| OS016788_i_at (OS016788_I_AT) | Similar to gi\|9294163\|dbj\|BAB02065.1\|contains similarity to nitrate-induced NOI protein~gene_id: MJL12.1 [*Arabidopsis thaliana*] | 68173.m02465#MJL12_1 #AT3g25070#unknown protein Length = 215 | – | – |
| OS017020.1_at (OS017020.1_AT) | Similar to gi\|8072390\|gb\|AAF71978.1\|AC013453_3 Putative ABC transporter [*Arabidopsis thaliana*] | 68170.m01415#T16N11_3 #At1g15520#hypothetical protein Length = 1423 | – | – |
| OS017161.1_at (OS017161.1_AT) | Similar to gi\|3212871\|gb\|AAC23422.1\|putative methionine aminopeptidase [*Arabidopsis thaliana*] | 51595.m12538#F6E13.31 #At2g44180#putative methionine aminopeptidase Length = 431 | – | – |
| OS017358_at (OS017358_AT) | Similar to gi\|4263704\|gb\|AAD15390.1\|putative hydrolase [*Arabidopsis thaliana*] | 51595.m11364#F22D22.10 #At2g32150#putative hydrolase # Length = 256 | – | – |
| OS017404_at (OS017404_AT) | Similar to gi\|4490292\|emb\|CAB38783.1\| putative protein [*Arabidopsis thaliana*] | 68164.m03149#F17M5_10 #AT4g33250#putative protein Length = 226 | – | – |
| OS017439_s_at (OS017439_S_AT) | Similar to gi\|5262775\|emb\|CAB45880.1\| putative protein [*Arabidopsis thaliana*] | 68164.m01913#T13K14_10 #AT4g20850#putative protein Length = 1396 | – | – |
| OS017523_at (OS017523_AT) | Similar to gi\|4467159\|emb\|CAB37528.1\| hypothetical protein [*Arabidopsis thaliana*] | 68170.m03172#F12K21_18 #At1g34470#unknown protein Length = 368 | – | – |
| OS017653_s_at (OS017653_S_AT) | Similar to gi\|7269799\|emb\|CAB79659.1\|AIM1 protein [*Arabidopsis thaliana*] | 68164.m02726#F19B15_40 #AT4g29010#AIM1 protein Length = 721 | – | – |
| OS018216.1_at | Similar to ADK_YEAST P47143 | 68172.m00230#AT5g03300 | | |

TABLE 5-continued

Table 5 shows 339 rice probesets corresponding to rice genes induced by pathogen infection

| ProbeSet | 1. Description | *Arabidopsis* Match | Ps | Bc |
|---|---|---|---|---|
| (OS018216.1_AT) | *SACCHAROMYCES CEREVISIAE* (BAKER S YEAST). PUTATIVE ADENOSINE KINASE (EC 2.7.1.20). | #AT5g03300#adenosine kinase-like protein Length = 345 | | |
| OS019008.1_at (OS019008.1_AT) | Similar to TEGT_HUMAN P55061 O14938 *HOMO SAPIENS* (HUMAN). TEGT PROTEIN (TESTIS ENHANCED GENE TRANSCRIPT). | 68172.m03969#K14A3_7 #AT5g47120#Bax inhibitor-1 like Length = 247 | – | – |
| OS019909_at (OS019909_AT) | Similar to gi|4220486|gb|AAD12709.1| unknown protein [*Arabidopsis thaliana*] | 51595.m08547#T8O11.21 #At2g01620#unknown protein # Length = 292 | – | – |
| OS019946_s_at (OS019946_S_AT) | Similar to gi|4567284|gb|AAD23697.1|AC006841_30 unknown protein [*Arabidopsis thaliana*] | 51595.m10325#F3K23.29 #At2g21530#unknown protein # Length = 235 | – | – |
| OS020119_s_at (OS020119_S_AT) | Similar to gi|7269790|emb|CAB77790.1| putative oxidoreductase [*Arabidopsis thaliana*] | 68170.m04232#F14G24_9 #At1g52820#putative oxidoreductase Length = 317 | – | – |
| OS020128.1_at (OS020128.1_AT) | Similar to gi|7340708|emb|CAB82951.1| putative protein [*Arabidopsis thaliana*] | 68173.m05308#T12C14_70 #AT3g62370#putative protein Length = 361 | – | – |
| OS021586_at (OS021586_AT) | Similar to HEM1_EMENI P38092 *EMERICELLA NIDULANS* (*ASPERGILLUS NIDULANS*). 5-AMINOLEVULINIC ACID SYNTHASE, MITOCHONDRIAL PRECURSOR (EC 2.3.1.37)(DELTA-AMINOLEVULINATE SYNTHASE) (DELTA-ALA SYNTHETASE). | 68164.m03466#C7A10_880 #AT4g36480#serine C-palmitoyltransferase like protein Length = 475 | – | – |
| OS021689.1_at (OS021689.1_AT) | Similar to KICH_YEAST P20485 *SACCHAROMYCES CEREVISIAE* (BAKER S YEAST). CHOLINE KINASE (EC 2.7.1.32). | 68170.m06116#F1O17_1 #At1g74320#putative choline kinase Length = 348 | – | – |
| OS022008_at (OS022008_AT) | Similar to METC_YEAST P43623 *SACCHAROMYCES CEREVISIAE* (BAKER S YEAST). PUTATIVE CYSTATHIONINE BETA-LYASE (EC 4.4.1.8) (CBL) (BETA-CYSTATHIONASE) (CYSTEINE LYASE). | 68170.m05207#F1N19_22 #At1g64660#methionine/ cystathionine gamma lyase, putative Length = 441 | – | – |
| OS023225_at (OS023225_AT) | Similar to XLYA_BACSU P39800 *BACILLUS SUBTILIS*. N-ACETYLMURAMOYL-L-ALANINE AMIDASE XYLA PRECURSOR (EC 3.5.1.28)(CELL WALL HYDROLASE) (AUTOLYSIN). | no_hits | – | – |
| OS023980.1_at (OS023980.1_AT) | Similar to PMGI_MAIZE P30792 *ZEA MAYS* (MAIZE). 2,3-BISPHOSPHOGLYCERATE-INDEPENDENT PHOSPHOGLYCERATE MUTASE(EC 5.4.2.1) (PHOSPHOGLYCEROMUTASE) (BPG-INDEPENDENT PGAM). | 68170.m00855#F21M12_17 #At1g09780#putative 2,3-bisphosphoglycerate-independent phosphoglycerate mutase Length = 575 | – | – |
| OS024114_at (OS024114_AT) | Similar to gi|8885527|dbj|BAA97457.1| gene_id: F17P19.3~unknown protein [*Arabidopsis thaliana*] | no_hits | – | – |
| OS024662_at (OS024662_AT) | Similar to gi|2244828|emb|CAB10251.1| hypothetical protein [*Arabidopsis thaliana*] | 68170.m06191#F9E10_20 #At1g74950#unknown protein Length = 249 | – | – |
| OS025101_at (OS025101_AT) | Similar to gi|7211990|gb|AAF40461.1|AC004809_19 Contains similarity to zinc finger protein from *Arabidopsis thaliana* gb|AC018363. EST gb|AA713271 comes from this gene. | 68172.m05637#MDC12_23 #AT5g63260#putative protein Length = 435 | – | – |

TABLE 6

Table 6 illustrates the correlation between rice probeset number ("OS") and *SEQ ID number

| *SEQ ID NO: (DNA) | *SEQ ID NO: (Protein) | ProbeSet |
|---|---|---|
| 3435 | 3436 | OS001183 |
| 4515 | 4516 | OS009555 |
| 4751 | 4752 | OS003892 |
| 4805 | 4806 | OS000349 |
| 5005 | 5006 | OS003712 |
| 6463 | 6464 | OS000318 |
| 7231 | 7232 | OS000404 |
|  |  | OS000405 |
| 8225 | 8226 | OS010405 |
| 8375 | 8376 | OS009475 |
|  |  | OS005811 |
| 8539 | 8540 | OS011249 |
| 8557 | 8558 | OS013473 |
| 9485 | 9486 | OS001345 |
|  |  | OS004223 |
|  |  | OS006340 |
| 9489 | 9490 | OS012567 |
| 10047 | 10048 | no_os |
| 10449 | 10450 | OS005352 |
| 10699 | 10700 | OS011949 |
| 14893 | 14894 | OS_ORF019683 |
| 17487 | 17488 | OS005652 |
| 17651 | 17652 | OS002493 |
| 18419 | 18420 | OS006436 |
| 18455 | 18456 | OS002761 |
|  |  | OS003991 |
| 18571 | 18572 | OS003517 |
| 18721 | 18722 | OS014557 |
| 19445 | 19446 | OS013164 |
|  |  | OS013280 |
|  |  | OS010185 |
|  |  | OS008536 |
| 19483 | 19484 | OS025101 |
| 19621 | 19622 | OS007548 |
| 21029 | 21030 | OS011227 |
| 21089 | 21090 | OS019568 |
| 21745 | 21746 | OS001183 |
| 22025 | 22026 | OS009655 |
| 22073 | 22074 | no_os |
| 22441 | 22442 | OS008432 |
| 22639 | 22640 | OS004308 |
|  |  | OS012885 |
| 22945 | 22946 | OS_ORF011634 |
| 24649 | 24650 | OS017040 |
| 24935 | 24936 | OS023225 |
| 25429 | 25430 | OS000820 |
|  |  | OS000639 |
| 25787 | 25788 | OS012482 |
| 26009 | 26010 | OS_ORF020195 |
| 26413 | 26414 | OS013352 |
|  |  | OS011273 |
| 26615 | 26616 | OS010771 |
|  |  | OS000860 |
|  |  | OS011019 |
| 27105 | 27106 | OS003253 |
| 27353 | 27354 | OS001915 |
|  |  | OS015767 |
|  |  | OS_ORF009925 |
| 27563 | 27564 | OS013473 |
| 27721 | 27722 | OS004858 |
| 27917 | 27918 | OS009885 |
|  |  | OS001771 |
|  |  | OS001218 |
| 28507 | 28508 | OS004150 |
|  |  | OS012082 |
|  |  | OS012083 |
| 28787 | 28788 | OS010906 |
| 28955 | 28956 | OS000286 |
| 29355 | 29356 | OS005541 |
| 29371 | 29372 | OS009655 |
| 30013 | 30014 | OS000608 |

TABLE 6-continued

Table 6 illustrates the correlation between rice probeset number ("OS") and *SEQ ID number

| *SEQ ID NO: (DNA) | *SEQ ID NO: (Protein) | ProbeSet |
|---|---|---|
| 30015 | 30016 | OS000609 |
|  |  | OS006332 |
| 30017 | 30018 | no_os |
| 30019 | 30020 | no_os |
| 30321 | 30322 | OS007132 |
| 31409 | 31410 | OS008661 |
| 31419 | 31420 | OS005645 |
|  |  | OS003383 |
|  |  | OS002821 |
| 31553 | 31554 | no_os |
| 32247 | 32248 | OS025101 |
| 32847 | 32848 | OS000336 |
| 33233 | 33234 | OS012146 |
| 33247 | 33248 | OS009655 |
| 33277 | 33278 | OS002718 |
| 34477 | 34478 | OS009475 |
|  |  | OS005811 |
| 34579 | 34580 | OS023980 |
| 34585 | 34586 | OS012567 |
| 35553 | 35554 | OS009019 |
| 35753 | 35754 | OS005111 |
|  |  | OS005586 |
| 35955 | 35956 | OS012482 |
| 36373 | 36374 | OS001855 |
| 36457 | 36458 | OS001062 |
|  |  | OS004086 |
|  |  | OS004260 |
| 36887 | 36888 | OS_ORF003478 |
|  |  | OS_ORF003479 |
| 37003 | 37004 | OS001309 |
| 37037 | 37038 | OS000739 |
| 37437 | 37438 | OS010209 |
| 37749 | 37750 | OS012641 |
|  |  | OS011033 |
| 38049 | 38050 | OS003780 |
| 38489 | 38490 | OS001195 |
|  |  | OS005279 |
| 38667 | 38668 | OS003806 |
| 39117 | 39118 | OS000783 |
|  |  | OS000310 |
| 39307 | 39308 | OS_ORF016581 |
| 39381 | 39382 | OS015052 |
|  |  | OS015607 |
| 39613 | 39614 | OS010299 |
|  |  | OS020581 |
|  |  | OS004884 |
| 40527 | 40528 | OS012482 |
| 40721 | 40722 | OS013502 |
|  |  | OS008005 |
| 41191 | 41192 | OS010209 |
| 41815 | 41816 | OS000876 |
|  |  | OS014097 |
| 42033 | 42034 | OS013502 |
|  |  | OS008005 |
| 42321 | 42322 | OS005680 |
|  |  | OS003659 |
| 42493 | 42494 | OS013977 |
| 42619 | 42620 | OS012070 |
| 42849 | 42850 | OS009588 |
| 42935 | 42936 | OS014260 |
|  |  | OS_ORF010353 |
| 42981 | 42982 | OS009885 |
|  |  | OS001771 |
|  |  | OS001218 |
| 43055 | 43056 | OS008316 |
|  |  | OS018530 |
|  |  | OS016477 |
| 43897 | 43898 | OS005634 |
| 44537 | 44538 | OS002811 |
| 45397 | 45398 | OS012526 |
| 45433 | 45434 | OS000608 |
| 45965 | 45966 | OS002675 |

TABLE 6-continued

Table 6 illustrates the correlation between rice probeset number ("OS") and *SEQ ID number

| *SEQ ID NO: (DNA) | *SEQ ID NO: (Protein) | ProbeSet |
|---|---|---|
| 46085 | 46086 | OS010209 |
| 47617 | 47618 | OS009655 |
| 49247 | 49248 | OS010844 |
|  |  | OS014023 |
| 49655 | 49656 | OS004321 |
| 49863 | 49864 | OS007629 |
|  |  | OS002115 |
| 52885 | 52886 | OS_ORF003709 |
|  |  | OS000424 |
| 52963 | 52964 | OS009555 |
| 53445 | 53446 | OS001045 |
|  |  | OS001589 |
|  |  | OS5001671 |
|  |  | OS010031 |
| 54223 | 54224 | OS_ORF008438 |
| 55307 | 55308 | OS000244 |
|  |  | OS005026 |
|  |  | OS007518 |
| 55317 | 55318 | OS012641 |
|  |  | OS011033 |
| 55339 | 55340 | OS012376 |
| 55641 | 55642 | OS010209 |
| 56125 | 56126 | OS007548 |
| 56755 | 56756 | OS000187 |
| 57639 | 57640 | OS000608 |
| 58035 | 58036 | OS_ORF018471 |
|  |  | OS008470 |
| 58169 | 58170 | OS002059 |
| 59791 | 59792 | OS001226 |
| 60451 | 60452 | OS010415 |
|  |  | OS002061 |
|  |  | OS002264 |
|  |  | OS013624 |
| 61317 | 61318 | OS004187 |
| 61499 | 61500 | OS008653 |
|  |  | OS006813 |
| 61705 | 61706 | OS004634 |
| 62145 | 62146 | OS018261 |
|  |  | OS009796 |
| 62281 | 62282 | OS000739 |
| 62617 | 62618 | OS008661 |
| 64063 | 64064 | OS000597 |
|  |  | OS002053 |
|  |  | OS_ORF021291 |
| 64531 | 64532 | OS000876 |
|  |  | OS014097 |
| 65605 | 65606 | OS_ORF003709 |
|  |  | OS000424 |
| 65633 | 65634 | OS007627 |
|  |  | OS012037 |
| 65955 | 65956 | OS023980 |
| 66561 | 66562 | OS014713 |
| 68061 | 68062 | OS005226 |
|  |  | OS005481 |
|  |  | OS001148 |
| 68265 | 68266 | OS002761 |
|  |  | OS003991 |
| 68337 | 68338 | OS001012 |
| 55339 | 55340 | OS012376 |
| 55641 | 55642 | OS010209 |
| 56125 | 56126 | OS007548 |
| 56755 | 56756 | OS000187 |
| 57639 | 57640 | OS000608 |
| 58035 | 58036 | OS_ORF018471 |
|  |  | OS008470 |
| 58169 | 58170 | OS002059 |
| 59791 | 59792 | OS001226 |
| 60451 | 60452 | OS010415 |
|  |  | OS002061 |
|  |  | OS002264 |
|  |  | OS013624 |
| 61317 | 61318 | OS004187 |

TABLE 6-continued

Table 6 illustrates the correlation between rice probeset number ("OS") and *SEQ ID number

| *SEQ ID NO: (DNA) | *SEQ ID NO: (Protein) | ProbeSet |
|---|---|---|
| 61499 | 61500 | OS008653 |
|  |  | OS006813 |
| 61705 | 61706 | OS004634 |
| 62145 | 62146 | OS018261 |
|  |  | OS009796 |
| 62281 | 62282 | OS000739 |
| 62617 | 62618 | OS008661 |
| 64063 | 64064 | OS000597 |
|  |  | OS002053 |
|  |  | OS_ORF021291 |
| 64531 | 64532 | OS000876 |
|  |  | OS014097 |
| 65605 | 65606 | OS_ORF003709 |
|  |  | OS000424 |
| 65633 | 65634 | OS007627 |
|  |  | OS012037 |
| 65955 | 65956 | OS023980 |
| 66561 | 66562 | OS014713 |
| 68061 | 68062 | OS005226 |
|  |  | OS005481 |
|  |  | OS001148 |
| 68265 | 68266 | OS002761 |
|  |  | OS003991 |
| 68337 | 68338 | OS001012 |
| 68705 | 68706 | OS005778 |
|  |  | OS012817 |
| 69011 | 69012 | OS009885 |
|  |  | OS001771 |
|  |  | OS001218 |
| 69037 | 69038 | OS004946 |
| 69299 | 69300 | OS005182 |
| 69419 | 69420 | OS_ORF018440 |
|  |  | OS007941 |
| 69675 | 69676 | OS002131 |
|  |  | OS009704 |
| 69811 | 69812 | OS019008 |
|  |  | OS_ORF015890 |
| 70845 | 70846 | OS004666 |
|  |  | OS010810 |
|  |  | OS012557 |
| 72289 | 72290 | OS016132 |
|  |  | OS023818 |
|  |  | OS_ORF015944 |
|  |  | OS018548 |
|  |  | OS012074 |
| 73045 | 73046 | OS015683 |
| 73265 | 73266 | OS005645 |
|  |  | OS003383 |
|  |  | OS002821 |
| 73267 | 73268 | OS011767 |
| 73539 | 73540 | OS012641 |
|  |  | OS011033 |
| 73647 | 73648 | OS006625 |
| 73779 | 73780 | OS009388 |
| 74585 | 74586 | OS000796 |
|  |  | OS014287 |
|  |  | OS000716 |
| 74701 | 74702 | OS000926 |
| 75651 | 75652 | OS000597 |
|  |  | OS002053 |
|  |  | OS_ORF021291 |
| 76009 | 76010 | OS012847 |
|  |  | OS016225 |
|  |  | OS005361 |
| 76289 | 76290 | OS003029 |
| 76307 | 76308 | OS024114 |
| 76627 | 76628 | OS001768 |
| 77041 | 77042 | no_os |
| 78849 | 78850 | OS011227 |
| 78987 | 78988 | OS001012 |
| 80477 | 80478 | OS007248 |
|  |  | OS011590 |

TABLE 6-continued

Table 6 illustrates the correlation between rice probeset number ("OS") and *SEQ ID number

| *SEQ ID NO: (DNA) | *SEQ ID NO: (Protein) | ProbeSet |
|---|---|---|
| 80665 | 80666 | OS_ORF018018 |
| | | OS006550 |
| 81459 | 81460 | OS003029 |
| 81753 | 81754 | OS008490 |
| 84533 | 84534 | OS001265 |
| | | OS000536 |
| 86397 | 86398 | OS000281 |
| | | OS004170 |
| 86477 | 86478 | OS001195 |
| | | OS005279 |
| 87065 | 87066 | OS018216 |
| | | OS015333 |
| 88325 | 88326 | OS011954 |
| 89655 | 89656 | OS005846 |
| 90313 | 90314 | OS002131 |
| | | OS009704 |
| 90655 | 90656 | OS013473 |
| 91343 | 91344 | OS015964 |
| 92283 | 92284 | OS002230 |
| | | OS003332 |
| | | OS007676 |
| | | OS002157 |
| | | OS003390 |
| | | OS007181 |
| 92543 | 92544 | OS014557 |
| 92827 | 92828 | OS001563 |
| 93707 | 93708 | OS001396 |
| 94923 | 94924 | OS025228 |
| 95687 | 95688 | OS005312 |
| | | OS007672 |
| | | OS_ORF008363 |
| 95713 | 95714 | OS000352 |
| 96619 | 96620 | OS006436 |
| 97491 | 97492 | OS_ORF006220 |
| | | OS004916 |
| 97703 | 97704 | OS_ORF002652 |
| | | OS007966 |
| 97991 | 97992 | OS019909 |
| 99941 | 99942 | OS015683 |
| 100349 | 100350 | OS015102 |
| 100959 | 100960 | OS001915 |
| | | OS015767 |
| | | OS_ORF009925 |
| 101633 | 101634 | no_os |
| 102227 | 102228 | OS009475 |
| | | OS005811 |
| 102287 | 102288 | OS_ORF018440 |
| | | OS007941 |
| 103295 | 103296 | no_os |
| 104075 | 104076 | OS008661 |
| 104195 | 104196 | OS015683 |
| 104479 | 104480 | OS004128 |
| 105167 | 105168 | OS008661 |
| 105619 | 105620 | no_os |
| 105711 | 105712 | OS000352 |
| 105749 | 105750 | no_os |
| 106005 | 106006 | no_os |
| 106037 | 106038 | OS011767 |
| 106919 | 106920 | no_os |
| 107105 | 107106 | OS000608 |
| 107211 | 107212 | OS000876 |
| | | OS014097 |
| 107271 | 107272 | OS014557 |
| 107381 | 107382 | no_os |
| 109507 | 109508 | no_os |
| 110579 | 110580 | OS017040 |
| 110823 | 110824 | no_os |
| 110961 | 110962 | OS010771 |
| | | OS000860 |
| | | OS011019 |
| 128177 | 128178 | OS013382 |
| 129299 | 129300 | OS_ORF012127 |
| 129485 | 129486 | OS001563 |
| 135129 | 135130 | OS020619 |
| | | OS010991 |
| | | OS023751 |
| 135145 | 135146 | OS000294 |
| 135197 | 135198 | OS_ORF006203 |
| 135207 | 135208 | OS002752 |
| | | OS007597 |
| | | OS012786 |
| 150001 | 150002 | OS001915 |
| | | OS015767 |
| | | OS_ORF009925 |
| 150003 | 150004 | OS002144 |
| 150005 | 150006 | OS000349 |
| 150007 | 150008 | no_os |
| 150009 | 150010 | OS008985 |
| | | OS007568 |
| 150011 | 150012 | OS009344 |
| | | OS021146 |
| 150013 | 150014 | OS_ORF016581 |
| 150015 | 150016 | no_os |
| 150017 | 150018 | OS012932 |
| | | OS011054 |
| | | OS_ORF001193 |
| 150019 | 150020 | OS010209 |
| 150021 | 150022 | OS000638 |
| 150023 | 150024 | OS002924 |
| 150025 | 150026 | OS008490 |
| 150027 | 150028 | OS016556 |
| | | OS003232 |
| 150029 | 150030 | OS005312 |
| | | OS007672 |
| | | OS_ORF008363 |
| 150031 | 150032 | OS002089 |
| | | OS005858 |
| 150033 | 150034 | OS004163 |
| | | OS010330 |
| 150035 | 150036 | OS009417 |
| | | OS022641 |
| 150037 | 150038 | OS005541 |
| 150039 | 150040 | OS013502 |
| | | OS008005 |
| 150041 | 150042 | OS001030 |
| 150043 | 150044 | OS002786 |
| | | OS004156 |
| 150045 | 150046 | OS025228 |
| 150047 | 150048 | OS002484 |
| | | OS_ORF008199 |
| 150049 | 150050 | OS015342 |
| 150051 | 150052 | OS001254 |
| | | OS001255 |
| | | OS001192 |
| | | OS001676 |
| 150053 | 150054 | OS_ORF005000 |
| | | OS012243 |
| 150055 | 150056 | OS009647 |
| 150057 | 150058 | OS006260 |
| 150059 | 150060 | OS008661 |
| 150061 | 150062 | OS007607 |
| 150063 | 150064 | OS000590 |
| | | OS000852 |
| | | OS003773 |
| 150065 | 150066 | OS001226 |
| 150067 | 150068 | OS005401 |
| | | OS_ORF016269 |
| | | OS001027 |
| 150069 | 150070 | OS015683 |
| 150071 | 150072 | OS012114 |
| | | OS011728 |
| 150073 | 150074 | no_os |
| 150075 | 150076 | OS001309 |
| 150077 | 150078 | OS_ORF009608 |

TABLE 6-continued

Table 6 illustrates the correlation between rice probeset number ("OS") and *SEQ ID number

| *SEQ ID NO: (DNA) | *SEQ ID NO: (Protein) | ProbeSet |
|---|---|---|
| 150079 | 150080 | OS012945 |
| 150081 | 150082 | no_os |
| 150083 | 150084 | OS003517 |
| 150085 | 150086 | OS000959 |
| 150087 | 150088 | OS001113 |
| 150089 | 150090 | OS022821 |
|  |  | OS021002 |
| 150091 | 150092 | OS009718 |
| 150093 | 150094 | OS_ORF018339 |
|  |  | OS008771 |
| 150095 | 150096 | OS005483 |
| 150097 | 150098 | OS014713 |
| 150099 | 150100 | OS006971 |
| 150101 | 150102 | OS003958 |
| 150103 | 150104 | OS001127 |
| 150105 | 150106 | OS014557 |
| 150107 | 150108 | OS017040 |
| 150109 | 150110 | OS004603 |
|  |  | OS008604 |
| 150111 | 150112 | OS001875 |
| 150113 | 150114 | OS004128 |
| 150115 | 150116 | OS022008 |
|  |  | OS009645 |
| 150117 | 150118 | OS023995 |
| 150119 | 150120 | OS012567 |
| 150121 | 150122 | OS012349 |
|  |  | OS020092 |
| 150123 | 150124 | OS005370 |
| 150125 | 150126 | OS011227 |
| 150127 | 150128 | OS000581 |
| 150129 | 150130 | OS_ORF019683 |
| 150131 | 150132 | OS000185 |
| 150133 | 150134 | no_os |

TABLE 7

The following table illustrates the correlation between the *SEQ ID NOs mentioned in the application text and the claims and the SEQ ID NOs provided in the Sequence Listing. (for example, SEQ ID NO: 1 in the Sequence Listing corresponds to *SEQ ID NO: 3435 mentioned in the application text and the claims)

| SEQ ID NO (Seq Listing) | *SEQ ID NO (Text) |
|---|---|
| 1 | 3435 |
| 2 | 3436 |
| 3 | 150001 |
| 4 | 150002 |
| 5 | 4515 |
| 6 | 4516 |
| 7 | 4751 |
| 8 | 4752 |
| 9 | 4805 |
| 10 | 4806 |
| 11 | 5005 |
| 12 | 5006 |
| 13 | 150003 |
| 14 | 150004 |
| 15 | 150005 |
| 16 | 150006 |
| 17 | 135207 |
| 18 | 135208 |
| 19 | 6463 |
| 20 | 6464 |
| 21 | 7231 |
| 22 | 7232 |
| 23 | 8225 |
| 24 | 8226 |
| 25 | 8375 |
| 26 | 8376 |
| 27 | 8539 |
| 28 | 8540 |
| 29 | 8557 |
| 30 | 8558 |
| 31 | 150007 |
| 32 | 150008 |
| 33 | 9485 |
| 34 | 9486 |
| 35 | 9489 |
| 36 | 9490 |
| 37 | 10047 |
| 38 | 10048 |
| 39 | 10449 |
| 40 | 10450 |
| 41 | 10699 |
| 42 | 10700 |
| 43 | 150009 |
| 44 | 150010 |
| 45 | 14893 |
| 46 | 14894 |
| 47 | 150011 |
| 48 | 150012 |
| 49 | 150013 |
| 50 | 150014 |
| 51 | 17487 |
| 52 | 17488 |
| 53 | 17651 |
| 54 | 17652 |
| 55 | 18419 |
| 56 | 18420 |
| 57 | 18455 |
| 58 | 18456 |
| 59 | 150015 |
| 60 | 150016 |
| 61 | 18571 |
| 62 | 18572 |
| 63 | 18721 |
| 64 | 18722 |
| 65 | 150017 |
| 66 | 150018 |
| 67 | 19445 |
| 68 | 19446 |
| 69 | 19483 |
| 70 | 19484 |
| 71 | 19621 |
| 72 | 19622 |
| 73 | 150019 |
| 74 | 150020 |
| 75 | 150021 |
| 76 | 150022 |
| 77 | 150023 |
| 78 | 150024 |
| 79 | 21029 |
| 80 | 21030 |
| 81 | 21089 |
| 82 | 21090 |
| 83 | 150025 |
| 84 | 150026 |
| 85 | 150027 |
| 86 | 150028 |
| 87 | 21745 |
| 88 | 21746 |
| 89 | 22025 |
| 90 | 22026 |
| 91 | 22073 |
| 92 | 22074 |

TABLE 7-continued

The following table illustrates the correlation between the *SEQ ID NOs mentioned in the application text and the claims and the SEQ ID NOs provided in the Sequence Listing. (for example, SEQ ID NO: 1 in the Sequence Listing corresponds to *SEQ ID NO: 3435 mentioned in the application text and the claims)

| SEQ ID NO (Seq Listing) | *SEQ ID NO (Text) |
| --- | --- |
| 93 | 22441 |
| 94 | 22442 |
| 95 | 22639 |
| 96 | 22640 |
| 97 | 22945 |
| 98 | 22946 |
| 99 | 150029 |
| 100 | 150030 |
| 101 | 24649 |
| 102 | 24650 |
| 103 | 24935 |
| 104 | 24936 |
| 105 | 25429 |
| 106 | 25430 |
| 107 | 25787 |
| 108 | 25788 |
| 109 | 26009 |
| 110 | 26010 |
| 111 | 26413 |
| 112 | 26414 |
| 113 | 150031 |
| 114 | 150032 |
| 115 | 26615 |
| 116 | 26616 |
| 117 | 27105 |
| 118 | 27106 |
| 119 | 27353 |
| 120 | 27354 |
| 121 | 27563 |
| 122 | 27564 |
| 123 | 27721 |
| 124 | 27722 |
| 125 | 27917 |
| 126 | 27918 |
| 127 | 150033 |
| 128 | 150034 |
| 129 | 28507 |
| 130 | 28508 |
| 131 | 28787 |
| 132 | 28788 |
| 133 | 28955 |
| 134 | 28956 |
| 135 | 150035 |
| 136 | 150036 |
| 137 | 29355 |
| 138 | 29356 |
| 139 | 29371 |
| 140 | 29372 |
| 141 | 30013 |
| 142 | 30014 |
| 143 | 30015 |
| 144 | 30016 |
| 145 | 30017 |
| 146 | 30018 |
| 147 | 30019 |
| 148 | 30020 |
| 149 | 150037 |
| 150 | 150038 |
| 151 | 30321 |
| 152 | 30322 |
| 153 | 150039 |
| 154 | 150040 |
| 155 | 150041 |
| 156 | 150042 |
| 157 | 31409 |
| 158 | 31410 |
| 159 | 31419 |
| 160 | 31420 |
| 161 | 31553 |
| 162 | 31554 |
| 163 | 150043 |
| 164 | 150044 |
| 165 | 150045 |
| 166 | 150046 |
| 167 | 32247 |
| 168 | 32248 |
| 169 | 32847 |
| 170 | 32848 |
| 171 | 33233 |
| 172 | 33234 |
| 173 | 33247 |
| 174 | 33248 |
| 175 | 33277 |
| 176 | 33278 |
| 177 | 34477 |
| 178 | 34478 |
| 179 | 34579 |
| 180 | 34580 |
| 181 | 34585 |
| 182 | 34586 |
| 183 | 150047 |
| 184 | 150048 |
| 185 | 35553 |
| 186 | 35554 |
| 187 | 35753 |
| 188 | 35754 |
| 189 | 35955 |
| 190 | 35956 |
| 191 | 128177 |
| 192 | 128178 |
| 193 | 36373 |
| 194 | 36374 |
| 195 | 36457 |
| 196 | 36458 |
| 197 | 36887 |
| 198 | 36888 |
| 199 | 37003 |
| 200 | 37004 |
| 201 | 37037 |
| 202 | 37038 |
| 203 | 37437 |
| 204 | 37438 |
| 205 | 37749 |
| 206 | 37750 |
| 207 | 135197 |
| 208 | 135198 |
| 209 | 38049 |
| 210 | 38050 |
| 211 | 38489 |
| 212 | 38490 |
| 213 | 38667 |
| 214 | 38668 |
| 215 | 39117 |
| 216 | 39118 |
| 217 | 39307 |
| 218 | 39308 |
| 219 | 39381 |
| 220 | 39832 |
| 221 | 39613 |
| 222 | 39614 |
| 223 | 150049 |
| 224 | 150050 |
| 225 | 150051 |
| 226 | 150052 |
| 227 | 40527 |
| 228 | 40528 |
| 229 | 40721 |
| 230 | 40722 |

TABLE 7-continued

The following table illustrates the correlation between the *SEQ ID NOs mentioned in the application text and the claims and the SEQ ID NOs provided in the Sequence Listing. (for example, SEQ ID NO: 1 in the Sequence Listing corresponds to *SEQ ID NO: 3435 mentioned in the application text and the claims)

| SEQ ID NO (Seq Listing) | *SEQ ID NO (Text) |
|---|---|
| 231 | 41191 |
| 232 | 41192 |
| 233 | 150053 |
| 234 | 150054 |
| 235 | 41815 |
| 236 | 41816 |
| 237 | 42033 |
| 238 | 42034 |
| 239 | 42321 |
| 240 | 42322 |
| 241 | 42493 |
| 242 | 42494 |
| 243 | 42619 |
| 244 | 42620 |
| 245 | 42849 |
| 246 | 42850 |
| 247 | 42935 |
| 248 | 42936 |
| 249 | 42981 |
| 250 | 42982 |
| 251 | 43055 |
| 252 | 43056 |
| 253 | 150055 |
| 254 | 150056 |
| 255 | 43897 |
| 256 | 43898 |
| 257 | 44537 |
| 258 | 44538 |
| 259 | 45397 |
| 260 | 45398 |
| 261 | 45433 |
| 262 | 45434 |
| 263 | 45965 |
| 264 | 45966 |
| 265 | 46085 |
| 266 | 46086 |
| 267 | 150057 |
| 268 | 150058 |
| 269 | 47617 |
| 270 | 47618 |
| 271 | 150059 |
| 272 | 150060 |
| 273 | 150061 |
| 274 | 150062 |
| 275 | 49247 |
| 276 | 49248 |
| 277 | 49655 |
| 278 | 49656 |
| 279 | 150063 |
| 280 | 150064 |
| 281 | 49863 |
| 282 | 49864 |
| 283 | 150065 |
| 284 | 150066 |
| 285 | 150067 |
| 286 | 150068 |
| 287 | 52885 |
| 288 | 52886 |
| 289 | 52963 |
| 290 | 52964 |
| 291 | 53445 |
| 292 | 53446 |
| 293 | 135145 |
| 294 | 135146 |
| 295 | 135129 |
| 296 | 135130 |
| 297 | 54223 |
| 298 | 54224 |
| 299 | 55307 |
| 300 | 55308 |
| 301 | 55317 |
| 302 | 55318 |
| 303 | 55339 |
| 304 | 55340 |
| 305 | 55641 |
| 306 | 55642 |
| 307 | 56125 |
| 308 | 56126 |
| 309 | 150069 |
| 310 | 150070 |
| 311 | 56755 |
| 312 | 56756 |
| 313 | 150071 |
| 314 | 150072 |
| 315 | 57639 |
| 316 | 57640 |
| 317 | 58035 |
| 318 | 58036 |
| 319 | 58169 |
| 320 | 58170 |
| 321 | 150073 |
| 322 | 150074 |
| 323 | 150075 |
| 324 | 150076 |
| 325 | 150077 |
| 326 | 150078 |
| 327 | 59791 |
| 328 | 59792 |
| 329 | 150079 |
| 330 | 150080 |
| 331 | 60451 |
| 332 | 60452 |
| 333 | 61317 |
| 334 | 61318 |
| 335 | 61499 |
| 336 | 61500 |
| 337 | 61705 |
| 338 | 61706 |
| 339 | 62145 |
| 340 | 62146 |
| 341 | 62281 |
| 342 | 62282 |
| 343 | 62617 |
| 344 | 62618 |
| 345 | 64063 |
| 346 | 64064 |
| 347 | 150081 |
| 348 | 150082 |
| 349 | 64531 |
| 350 | 64532 |
| 351 | 65605 |
| 352 | 65606 |
| 353 | 65633 |
| 354 | 65634 |
| 355 | 150083 |
| 356 | 150084 |
| 357 | 65955 |
| 358 | 65956 |
| 359 | 66561 |
| 360 | 66562 |
| 361 | 150085 |
| 362 | 150086 |
| 363 | 150087 |
| 364 | 150088 |
| 365 | 68061 |
| 366 | 68062 |
| 367 | 68265 |
| 368 | 68266 |

TABLE 7-continued

The following table illustrates the correlation between the *SEQ ID NOs mentioned in the application text and the claims and the SEQ ID NOs provided in the Sequence Listing. (for example, SEQ ID NO: 1 in the Sequence Listing corresponds to *SEQ ID NO: 3435 mentioned in the application text and the claims)

| SEQ ID NO (Seq Listing) | *SEQ ID NO (Text) |
|---|---|
| 369 | 68337 |
| 370 | 68338 |
| 371 | 68705 |
| 372 | 68706 |
| 373 | 150089 |
| 374 | 150090 |
| 375 | 69011 |
| 376 | 69012 |
| 377 | 69037 |
| 378 | 69038 |
| 379 | 69299 |
| 380 | 69300 |
| 381 | 69419 |
| 382 | 69420 |
| 383 | 69675 |
| 384 | 69676 |
| 385 | 69811 |
| 386 | 69812 |
| 387 | 150091 |
| 388 | 150092 |
| 389 | 150093 |
| 390 | 150094 |
| 391 | 70845 |
| 392 | 70846 |
| 393 | 72289 |
| 394 | 72290 |
| 395 | 150095 |
| 396 | 150096 |
| 397 | 73045 |
| 398 | 73046 |
| 399 | 3265 |
| 400 | 73266 |
| 401 | 73267 |
| 402 | 73268 |
| 403 | 73539 |
| 404 | 73540 |
| 405 | 73647 |
| 406 | 73648 |
| 407 | 73779 |
| 408 | 73780 |
| 409 | 150097 |
| 410 | 150098 |
| 411 | 74585 |
| 412 | 74586 |
| 413 | 74701 |
| 414 | 74702 |
| 415 | 75651 |
| 416 | 75652 |
| 417 | 76009 |
| 418 | 76010 |
| 419 | 76289 |
| 420 | 76290 |
| 421 | 76307 |
| 422 | 76308 |
| 423 | 150099 |
| 424 | 150100 |
| 425 | 76627 |
| 426 | 76628 |
| 427 | 77041 |
| 428 | 77042 |
| 429 | 150101 |
| 430 | 150102 |
| 431 | 150103 |
| 432 | 150104 |
| 433 | 150105 |
| 434 | 150106 |
| 435 | 129299 |
| 436 | 129300 |
| 437 | 150107 |
| 438 | 150108 |
| 439 | 78849 |
| 440 | 78850 |
| 441 | 78987 |
| 442 | 78988 |
| 443 | 80477 |
| 444 | 80478 |
| 445 | 80665 |
| 446 | 80666 |
| 447 | 150109 |
| 448 | 150110 |
| 449 | 150111 |
| 450 | 150112 |
| 451 | 81459 |
| 452 | 81460 |
| 453 | 150113 |
| 454 | 150114 |
| 455 | 81753 |
| 456 | 81754 |
| 457 | 150115 |
| 458 | 150116 |
| 459 | 129485 |
| 460 | 129486 |
| 461 | 84533 |
| 462 | 84534 |
| 463 | 150117 |
| 464 | 150118 |
| 465 | 86397 |
| 466 | 86398 |
| 467 | 86477 |
| 468 | 86478 |
| 469 | 87065 |
| 470 | 7066 |
| 471 | 88325 |
| 472 | 88326 |
| 473 | 150119 |
| 474 | 150120 |
| 475 | 89655 |
| 476 | 89656 |
| 477 | 90313 |
| 478 | 90314 |
| 479 | 150121 |
| 480 | 150122 |
| 481 | 90655 |
| 482 | 90656 |
| 483 | 91343 |
| 484 | 91344 |
| 485 | 150123 |
| 486 | 150124 |
| 487 | 92283 |
| 488 | 92284 |
| 489 | 92543 |
| 490 | 92544 |
| 491 | 92827 |
| 492 | 92828 |
| 493 | 93707 |
| 494 | 93708 |
| 495 | 150125 |
| 496 | 150126 |
| 497 | 94923 |
| 498 | 94924 |
| 499 | 95687 |
| 500 | 95688 |
| 501 | 95713 |
| 502 | 95714 |
| 503 | 96619 |
| 504 | 96620 |
| 505 | 150127 |
| 506 | 150128 |

TABLE 7-continued

The following table illustrates the correlation between the *SEQ ID NOs mentioned in the application text and the claims and the SEQ ID NOs provided in the Sequence Listing. (for example, SEQ ID NO: 1 in the Sequence Listing corresponds to *SEQ ID NO: 3435 mentioned in the application text and the claims)

| SEQ ID NO (Seq Listing) | *SEQ ID NO (Text) |
|---|---|
| 507 | 97491 |
| 508 | 97492 |
| 509 | 97703 |
| 510 | 97704 |
| 511 | 150129 |
| 512 | 150130 |
| 513 | 97991 |
| 514 | 97992 |
| 515 | 99941 |
| 516 | 99942 |
| 517 | 150131 |
| 518 | 150132 |
| 519 | 100349 |
| 520 | 100350 |
| 521 | 100959 |
| 522 | 100960 |
| 523 | 101633 |
| 524 | 101634 |
| 525 | 102227 |
| 526 | 102228 |
| 527 | 102287 |
| 528 | 102288 |
| 529 | 103295 |
| 530 | 103296 |
| 531 | 150133 |
| 532 | 150134 |
| 533 | 104075 |
| 534 | 104076 |
| 535 | 104195 |
| 536 | 104196 |
| 537 | 104479 |
| 538 | 104480 |
| 539 | 105167 |
| 540 | 105168 |
| 541 | 105619 |
| 542 | 105620 |
| 543 | 105711 |
| 544 | 105712 |
| 545 | 105749 |
| 546 | 105750 |
| 547 | 106005 |
| 548 | 106006 |
| 549 | 106037 |
| 550 | 106038 |
| 551 | 106919 |
| 552 | 106920 |
| 553 | 107105 |
| 554 | 107106 |
| 555 | 107211 |
| 556 | 107212 |
| 557 | 107271 |
| 558 | 107272 |
| 559 | 107381 |
| 560 | 107382 |
| 561 | 109507 |
| 562 | 109508 |
| 563 | 110579 |
| 564 | 110580 |
| 565 | 110823 |
| 566 | 110824 |
| 567 | 110961 |
| 568 | 110962 |

TABLE 8

This table illustrates the correlation between sub-group I and sub-group II sequences

| Group I SeqID | Group II SeqID |
|---|---|
| 11 | 629 |
| 13 | 633 |
| 15 | 627 |
| 21 | 655 |
| 33 | 659 |
| 53 | 653 |
| 93 | 669 |
| 141 | 625 |
| 155 | 657 |
| 167 | 663 |
| 281 | 637 |
| 319 | 661 |
| 325 | 643 |
| 333 | 671 |
| 351 | 641 |
| 365 | 631 |
| 399 | 665 |
| 415 | 639 |
| 417 | 667 |
| 427 | 649 |
| 469 | 647 |
| 477 | 635 |
| 493 | 651 |
| 523 | 645 |

TABLE 9

This table illustrates the correlation between sub-group I and sub-group III sequences

| Group III SEQ ID NO | Group I - SEQ ID NO |
|---|---|
| 673 | 117 |
| 675 | 13 |
| 677 | 169, 195 |
| 679 | 279 |
| 681 | 141 |
| 683 | 613, 569, 609 |
| 685 | 293 |
| 687 | 585, 609, 611 |
| 689 | 115 |
| 691 | 413 |
| 693 | 361 |
| 695 | 569, 585, 613, 609 |
| 697 | 583 |
| 699 | 155 |
| 701 | 393 |
| 703 | 169, 195 |
| 705 | 431 |
| 707 | 225 |
| 709 | 595, 593 |
| 711 | 569 |
| 713 | 493 |
| 715 | 399 |
| 717 | 193 |
| 719 | 477 |
| 721 | 175 |
| 723 | 623 |
| 725 | 531 |
| 727 | 613, 569, 609 |
| 729 | 239 |
| 731 | 7 |
| 733 | 429 |
| 735 | 453 |
| 737 | 129 |
| 739 | 377 |
| 741 | 113 |
| 743 | 445 |
| 745 | 381 |

TABLE 9-continued

This table illustrates the correlation between sub-group I and sub-group III sequences

| Group III SEQ ID NO | Group I - SEQ ID NO |
|---|---|
| 747 | 327 |
| 749 | 221 |
| 751 | 295 |
| 753 | 495 |
| 755 | 41 |
| 757 | 313 |
| 759 | 409 |
| 761 | 309 |
| 763 | 513 |
| 765 | 15 |
| 767 | 505 |
| 769 (505) | 613, 569, 609 |
| 771 | 291 |
| 773 | 33 |
| 775 | 213 |
| 777 | 333 |
| 779 | 579 |
| 781 | 485 |
| 783 | 349 |
| 785 | 519 |
| 787 | 483 |
| 789 | 283, 281 |
| 791 | 399 |
| 793 | 57 |
| 795 | 447 |
| 797 | 337 |
| 799 | 443 |
| 801 | 375 |
| 803 | 391 |
| 805 | 131 |
| 807 | 393 |
| 809 | 153 |
| 811 | 615, 247 |
| 813 | 385 |
| 815 | 273, 503 |
| 817 | 89 |
| 819 | 351 |
| 821 | 97 |
| 823 | 435 |
| 825 | 9 |

TABLE 10

This table illustrates the start and end points and the sequence of tri- and tetra-nucleotide repeat units in the coding region of a selection of SEQ ID NOs.

| Seq ID | Start | End | Sequence |
|---|---|---|---|
| 19 | 75 | 92 | CGG |
| 25 | 277 | 292 | AATC |
| 27 | 1053 | 1067 | GGC |
|  | 1193 | 1207 | CTT |
| 45 | 1346 | 1360 | AAG |
| 47 | 98 | 115 | CCG |
| 49 | 234 | 254 | CGG |
| 53 | 240 | 260 | CGA |
| 63 | 297 | 311 | CTT |
|  | 492 | 506 | CGG |
| 65 | 600 | 614 | CGG |
|  | 812 | 826 | ACG |
|  | 866 | 880 | ACG |
|  | 933 | 950 | CGG |
| 67 | 41 | 61 | ACC |
|  | 184 | 198 | GCG |
| 73 | 1436 | 1456 | CCG |
| 81 | 148 | 162 | GCG |
| 111 | 389 | 403 | CCG |
| 135 | 125 | 139 | CCT |
| 197 | 239 | 253 | CGC |
| 215 | 212 | 226 | CGG |
| 229 | 246 | 260 | CGG |
| 253 | 45 | 59 | CGG |
| 273 | 125 | 139 | CCG |
| 279 | 366 | 380 | CGC |
| 287 | 22 | 39 | CTC |
| 293 | 1912 | 1929 | CGG |
| 313 | 104 | 124 | CGG |
| 319 | 133 | 147 | ACC |
| 321 | 41 | 61 | AGC |
|  | 1061 | 1075 | AGC |
| 335 | 158 | 172 | ATC |
| 343 | 332 | 349 | AGG |
| 387 | 588 | 602 | CGG |
| 391 | 16 | 33 | GGA |
| 409 | 173 | 187 | CGG |
| 419 | 663 | 683 | CTG |
| 427 | 86 | 100 | AGC |
| 441 | 17 | 31 | CGG |
| 443 | 34 | 48 | CTG |
| 445 | 235 | 252 | GTG |
|  | 280 | 294 | CGG |
| 447 | 72 | 86 | CCT |
| 449 | 192 | 206 | GGT |

TABLE 10-continued

This table illustrates the start and end points and the sequence of tri- and tetra-nucleotide repeat units in the coding region of a selection of SEQ ID NOs.

| Seq ID | Start | End | Sequence |
|---|---|---|---|
| 451 | 5 | 22 | CCG |
|  | 268 | 282 | GCC |
|  | 977 | 991 | AGA |
| 457 | 1348 | 1368 | GCA |
| 491 | 814 | 831 | CCG |
| 507 | 20 | 34 | CCT |
|  | 49 | 63 | GCG |
| 515 | 7 | 24 | GAC |
| 517 | 59 | 73 | AGC |
|  | 237 | 251 | ATC |
| 519 | 62 | 76 | CGG |
| 531 | 72 | 92 | CGG |
|  | 91 | 105 | GGA |
|  | 248 | 265 | CGG |
|  | 441 | 455 | CGG |
| 537 | 603 | 620 | CGG |
| 571 | 1521 | 1535 | ACG |
| 579 | 751 | 768 | GCC |
| 587 | 296 | 310 | CCG |
|  | 317 | 331 | CCG |
| 589 | 1727 | 1742 | GAAA |
| 595 | 515 | 529 | CCG |

TABLE 11 this table provides SEQ ID NOs of banana, wheat and maize representing nucleotide sequences that are homologous to the rice sequences show in column 1.

| SEQ ID NO | BANANA | WHEAT | MAIZE |
|---|---|---|---|
| 1 | — | 991 | 1347 |
| 3 | 848 | 1060 | 1218 |
| 7 | 834 | 1128 | 1356 |
| 9 | — | 1085 | — |
| 11 | — | 1078 | 1337 |
| 13 | 935 | 1140 | 1267 |
| 15 | 969 | 1005 | 1325 |
| 17 | 940 | 976 | 1333 |
| 19 | 970 | 1062 | 1357 |
| 21 | — | 1083 | — |
| 23 | 927 | 1052 | 1285 |
| 25 | — | 1169 | — |
| 27 | 874 | 1203 | — |
| 31 | 850 | 1159 | — |
| 33 | 925 | 1033 | 1292 |
| 35 | 954 | 1073 | 1225 |
| 37 | 967 | 1023 | — |
| 39 | 966 | 1110 | 1261 |
| 41 | — | 1171 | 1362 |
| 43 | — | 1180 | — |
| 45 | 937 | 1181 | 1334 |
| 47 | 830 | 1135 | 1330 |
| 49 | — | 973 | 1222 |
| 51 | 857 | 983 | 1323 |
| 53 | — | 1047 | 1363 |
| 57 | 942 | 1150 | 1246 |
| 59 | — | 1004 | — |
| 61 | 910 | 1120 | 1365 |
| 63 | 908 | 985 | 1255 |
| 65 | — | 1059 | 1358 |
| 67 | 872 | 998 | 1329 |
| 71 | 946 | — | — |
| 73 | 921 | 1090 | 1315 |
| 75 | 877 | 1017 | 1211 |
| 77 | — | 1173 | 1355 |
| 81 | — | 1195 | — |
| 83 | — | 1003 | 1350 |
| 85 | — | 1183 | 1217 |
| 89 | 964 | 1165 | 1252 |
| 91 | — | 1002 | — |
| 93 | — | 1121 | 1290 |
| 95 | 859 | 990 | 1259 |
| 97 | 926 | 986 | 1277 |
| 99 | 831 | 1066 | 1364 |
| 103 | — | 1001 | — |
| 105 | 944 | 1095 | 1310 |
| 107 | — | 1037 | 1230 |
| 111 | — | 1193 | 1301 |
| 113 | 911 | 1199 | 1297 |
| 115 | 889 | 1130 | 1338 |
| 117 | 958 | 1151 | 1241 |
| 119 | — | 1075 | — |
| 121 | — | 1177 | — |
| 123 | 941 | 1036 | — |
| 127 | — | 1146 | 1260 |
| 129 | 829 | 1116 | 1386 |
| 131 | 959 | 1131 | 1348 |
| 133 | 948 | 1122 | 1382 |
| 135 | 968 | 1051 | 1276 |
| 141 | 971 | 1192 | 1274 |
| 143 | 971 | 1192 | 1248 |
| 145 | — | — | 1369 |
| 147 | — | 1192 | 1319 |
| 149 | 828 | 1034 | 1304 |
| 151 | — | 979 | 1375 |
| 153 | — | — | 1251 |
| 155 | 900 | 1190 | 1351 |
| 161 | — | 1044 | — |
| 163 | 952 | 1073 | 1225 |
| 165 | — | 1039 | — |
| 167 | — | 1070 | 1247 |
| 169 | 864 | 1149 | 1280 |
| 171 | 933 | — | 1311 |
| 175 | 930 | 1123 | 1223 |
| 179 | 909 | 1148 | 1361 |
| 183 | 950 | 972 | 1302 |
| 185 | 885 | — | — |
| 187 | 868 | 1115 | — |
| 189 | 913 | 1108 | — |
| 191 | — | 1026 | — |
| 193 | 867 | 1170 | 1289 |
| 195 | 864 | 1149 | 1280 |
| 197 | 827 | 993 | 1367 |

TABLE 11-continued this table provides SEQ ID NOs of banana, wheat and maize representing nucleotide sequences that are homologous to the rice sequences show in column 1.

| SEQ ID NO | BANANA | WHEAT | MAIZE |
|---|---|---|---|
| 199 | — | 1088 | 1265 |
| 205 | — | 1021 | 1373 |
| 207 | — | 1000 | — |
| 209 | — | — | 1242 |
| 211 | 865 | 1111 | 1236 |
| 213 | 855 | 1099 | 1215 |
| 215 | 839 | 1094 | 1370 |
| 219 | 861 | 1207 | — |
| 221 | — | 1056 | 1253 |
| 223 | 945 | 995 | 1249 |
| 225 | — | 1084 | — |
| 229 | — | 999 | 1383 |
| 233 | — | 1168 | — |
| 235 | — | 1016 | 1377 |
| 237 | 893 | 1162 | — |
| 239 | — | 1202 | 1273 |
| 241 | 961 | 1069 | 1328 |
| 243 | 931 | 1093 | 1300 |
| 245 | — | 1067 | — |
| 247 | 846 | 980 | — |
| 251 | 951 | 1064 | 1299 |
| 253 | — | 1079 | 1270 |
| 255 | 895 | 1042 | 1381 |
| 257 | 922 | 1035 | 1234 |
| 259 | 929 | 1187 | 1306 |
| 263 | 907 | 1029 | 1275 |
| 267 | 835 | 1204 | — |
| 271 | 871 | 1113 | 1235 |
| 273 | 890 | 1134 | — |
| 277 | — | 1043 | 1272 |
| 279 | 914 | 1118 | 1219 |
| 281 | — | — | 1336 |
| 283 | — | — | 1336 |
| 285 | — | 1045 | — |
| 287 | 899 | 1061 | 1309 |
| 289 | 924 | 1040 | — |
| 291 | — | 1091 | 1384 |
| 293 | 862 | 1087 | 1243 |
| 295 | — | 1185 | — |
| 297 | — | 1172 | — |
| 299 | 953 | 996 | 1343 |
| 303 | — | 1119 | 1353 |
| 309 | 837 | 1178 | 1349 |
| 311 | 901 | 1152 | 1312 |
| 313 | — | 1068 | 1368 |
| 317 | 875 | 1055 | 1258 |
| 319 | — | 1083 | — |
| 321 | 915 | 984 | 1366 |
| 323 | 883 | 988 | 1281 |
| 325 | — | 1050 | 1266 |
| 327 | 840 | 1176 | — |
| 329 | 902 | 1053 | 1240 |
| 331 | — | 1107 | — |
| 333 | — | 1065 | — |
| 335 | 956 | 1097 | 1308 |
| 337 | 955 | 1096 | 1241 |
| 339 | 903 | 1157 | — |
| 341 | 832 | 1112 | 1244 |
| 343 | — | — | 1295 |
| 347 | — | 974 | — |
| 349 | 888 | 975 | 1216 |
| 351 | — | 1083 | — |
| 353 | 886 | 1018 | — |
| 355 | 906 | 1154 | 1288 |
| 359 | — | 997 | 1378 |
| 361 | — | 1048 | 1313 |
| 363 | 904 | 1153 | 1269 |
| 365 | 960 | 1098 | 1237 |
| 367 | — | 1008 | — |
| 371 | 873 | 1132 | 1264 |
| 373 | 849 | 989 | 1380 |
| 375 | 852 | 1174 | — |
| 377 | 853 | 992 | 1332 |
| 379 | 870 | 1081 | 1263 |
| 381 | — | 1074 | — |
| 383 | — | 1076 | 1232 |
| 385 | — | 1158 | 1227 |
| 387 | 881 | 1101 | 1294 |
| 389 | — | 1196 | 1279 |
| 391 | — | 1117 | 1371 |
| 393 | 912 | 1031 | 1278 |
| 395 | — | 1014 | 1239 |
| 399 | 866 | 1077 | 1360 |
| 401 | 841 | — | — |
| 403 | — | 1166 | — |
| 405 | 934 | 1072 | 1345 |
| 407 | 919 | 1143 | 1221 |
| 409 | 896 | 1201 | 1307 |
| 411 | 928 | 1103 | 1327 |
| 413 | 932 | 1038 | 1257 |
| 415 | 842 | 1145 | 1340 |
| 417 | 869 | 1027 | 1213 |
| 419 | 879 | 1124 | 1271 |
| 421 | — | 1071 | — |
| 423 | 882 | 1032 | 1238 |
| 425 | 917 | 1100 | 1303 |
| 427 | 843 | 1049 | 1339 |
| 429 | — | 1163 | 1268 |
| 431 | 969 | 1005 | 1325 |
| 433 | 938 | 1007 | — |
| 435 | — | 1054 | — |
| 437 | 851 | 1160 | 1331 |
| 441 | 936 | 1089 | 1282 |
| 443 | 884 | 1063 | 1293 |
| 445 | 923 | 1139 | 1212 |
| 447 | — | 1197 | 1210 |
| 449 | 897 | 1011 | — |
| 451 | — | 1058 | 1231 |
| 453 | 916 | 1200 | 1344 |
| 457 | 858 | 1020 | 1296 |
| 459 | — | 1057 | 1214 |
| 461 | 943 | 1102 | 1359 |
| 463 | — | 1205 | 1254 |
| 465 | 947 | 1114 | — |
| 469 | 833 | 1137 | 1354 |
| 471 | 898 | 1138 | 1321 |
| 473 | — | 1167 | 1335 |
| 475 | 918 | 994 | — |
| 477 | 847 | 1125 | 1379 |
| 479 | 957 | 1129 | 1320 |
| 481 | — | 1082 | — |
| 483 | 894 | 1041 | 1226 |
| 485 | 876 | 1155 | 1250 |
| 487 | 955 | 1147 | 1224 |
| 491 | 880 | 1144 | — |
| 493 | — | 1164 | 1317 |
| 495 | — | 1126 | — |
| 501 | — | 1015 | 1262 |
| 503 | 890 | 1133 | 1223 |
| 505 | 963 | 1010 | 1326 |
| 507 | — | — | 1368 |
| 509 | 856 | 977 | 1245 |
| 511 | 887 | 1184 | 1316 |
| 513 | — | 1141 | — |
| 515 | — | 1030 | 1209 |
| 519 | — | 1182 | 1283 |
| 521 | — | 1019 | 1324 |
| 523 | 845 | 1156 | 1286 |
| 529 | — | 982 | 1233 |
| 531 | 900 | 1009 | 1372 |

TABLE 11-continued this table provides SEQ ID NOs
of banana, wheat and maize representing
nucleotide sequences that are homologous to
the rice sequences show in column 1.

| SEQ ID NO | BANANA | WHEAT | MAIZE |
|---|---|---|---|
| 537 | 838 | 1013 | 1374 |
| 541 | — | 1025 | — |
| 543 | 905 | 1188 | 1229 |
| 545 | 949 | 1161 | 1220 |
| 547 | 965 | 1109 | 1261 |
| 559 | 860 | 1136 | 1228 |
| 561 | 863 | 1194 | 1385 |
| 565 | — | 981 | — |
| 569 | 970 | 1104 | 1291 |
| 571 | — | 1186 | 1208 |
| 573 | 878 | 1022 | — |
| 575 | 836 | 1127 | 1305 |
| 577 | 891 | 1175 | 1298 |
| 579 | 851 | 1080 | 1376 |
| 581 | — | 1206 | — |
| 583 | 962 | 1189 | 1346 |
| 585 | 970 | 1106 | 1256 |
| 587 | 939 | 1028 | 1341 |
| 589 | 844 | 978 | 1352 |
| 591 | 892 | 1012 | 1322 |
| 593 | — | 1006 | 1318 |
| 595 | — | 1006 | 1318 |
| 599 | 854 | 1179 | 1342 |
| 601 | — | 1198 | — |
| 603 | 891 | 1086 | 1298 |
| 605 | — | 1046 | 1291 |
| 607 | — | 987 | — |
| 609 | 970 | 1104 | 1291 |
| 611 | — | 1105 | 1287 |
| 613 | 970 | 1104 | 1291 |
| 615 | — | 1092 | 1314 |
| 617 | 920 | — | 1352 |
| 619 | 878 | 1024 | 1284 |
| 621 | 962 | 1191 | 1346 |
| 623 | 962 | 1142 | 1346 |

REFERENCES

Aarts et al., *Proc. Natl. Acad. Sci.*, 95:10306 (1998).
Alonso et al., *Science* 284:2148 (1999)
Altschul et al., *J. Mol. Biol.* 215:403 (1990).
Altschul et al., *Nucleic Acids Res.* 25:3389 (1997).
An et al., *EMBO J.* 4:277 (1985).
Aoyama et al., *N-H Plant Journal* 11:605 (1997).
Austin, et al., *Science*, (2002).
Ausubel et al., Current Protocols in Molecular Biology (New York, Greene Publishing Associates/Wiley Interscience) (1995).
Bachem et al., *Plant J.*, 9:745 (1996).
Bailey and Elkan In: Proceedings of the second international Conference on Intelligent Systems for Molecular Biology (Altman, R., ed), pp 28-36, AAAI Press (1994).
Ballas et al., *Nucleic Acids Res.* 17:7891 (1989).
Balzi et al., *J. Biol. Chem.*, 269:2206 (1994).
Bansal et al., *Proc. Natl. Acad. Sci. USA*, 89:3654 (1992).
Batzer et al., *Nucleic Acid Res.*, 19:5081 (1991).
Beachy and Murakishi, *Phytopathology*, 61:877 (1971).
Beals et al., *Plant Cell*, 9:1527 (1997).
Belanger et al., *Genetics*, 129:863 (1991).
Bevan et al., *Nature*, 304:184 (1983).
Blochinger & Diggelmann, *Mol Cell Biol*, 4:2929.
Bourouis et al., *EMBO J.*, 2:1099 (1983).
Boyes et al., *Proc Natl Acad Sci USA*, 95:15849 (1998).
Byrne et al. *Plant Cell Tissue and Organ Culture*, 8:3 (1987).
Campbell and Gowri, *Plant Physiol.*, 92:1 (1990).
Canto and Palukaitis, *Virology*, 265:74 (1999).
Cao et al., *Plant Cell*, 6:1583 (1994).
Cao et al., *Cell*, 88:57 (1997).
Century et al., *Science*, 278:1963 (1997).
Chandler et al., *Plant Cell*, 1:1175 (1989).
Chen et al., *Nature Biotechnology*, 16:1060 (1998).
Christou et al., *Biotechnology*, 9:957 (1991).
Christou et al., *Plant Physiol.* 87:671 (1988).
Conklin and Last, *Plant Physiol.*, 109:203 (1995).
Cooper et al., *Virology*, 206:307 (1995)
Cooper et al., *Virology*, 216:208 (1996).
Cordero et al., *Plant J.*, 6:141 (1994).
Corpet et al., *Nucleic Acids Res.* 16:10881 (1988).
Crameri et al., *Nature Biotech.*, 15:436 (1997).
Crameri et al., *Nature*, 391:288 (1998).
Creelman et al., *Annu. Rev. Plant Physiol. Plant Mol. Biol.*, 48:355 (1997).
Crossway et al., *BioTechniques*, 4:320 (1986).
Czako et al., *Mol. Gen. Genet.* 23 5 (1), 33-40 (1992).
Czernic et al., *Plant Mol. Biol.*, 31:255 (1996).
Datta et al., *Bio/Technology* 8, 736 (1990).
Dayhoff et al., *Atlas of Protein Sequence and Structure*, Natl. Biomed. Res. Found., Washington, C. D. (1978).
De Blaere et al., *Meth. Enzymol.*, 143:277 (1987).
de Framond, *FEBS*, 290:103 (1991).
Delaney et al., *Proc. Natl. Acad. Sci. USA*, 92:6602 (1995).
Dela-Cioppa et al., *Plant Physiology*, 84:965 (1987).
De Oliveira et al., *Microbios.*, 76:213 (1993).
Dennis et al., *Nucleic Acids Res.*, 12:3983 (1984).
Dietrich et al., *Cell*, 88:685 (1997).
Dong et al., *Curr. Opin. Plant Biol.*, 1:316 (1998).
Dunigan and Madlener, *Virology*, 207:460 (1995).
Durrant et al., *The Plant Cell*, 12:963 (2000).
Dzelkalns et al., *Plant Cell*, 5:855 (1993).
Eisen et al., *Trends in Plant Sci.*, 95:14863 (2000).
Ellis and Jones, *Curr. Opin. Plant Bio.*, 1:288 (1998).
Eltoy-Stein et al., *PNAS USA*, 86:6126 (1989).
English, et al., *Plant Cell*, 8:179 (1996).
Eulgem et al., *Trends in Plant Sci.*, 5:199 (2000).
Falk et al., *Proc. Natl. Acad. Sci. USA*, 96:3292 (1999).
Feys et al., *Plant Cell*, 6:751 (1994).
Franken et al., *EMBO J.*, 10:2605 (1991).
Fromm et al., *Bio/Technology*, 8:833 (1990).
Gallie et al., *Molecular Biology of RNA*, 237 (1989).
Gallie et al., *Nucl. Acids Res.*, 15:8693 (1987).
Gan et al., *Science*, 270:1986 (1995).
Gatz, *Current Opinion in Biotechnology*, 7:168 (1996).
Gatz, *Annu. Rev. Plant Physiol. Plant Mol. Biol.*, 48:89 (1997).
Gelfand, eds., *PCR Strategies* (Academnic Press, New York (1995)).
Glazebrook, J., *Curr. Opin. Plat Biology*, 2:280 (1999).
Glazebrook et al., *Genetics*, 143:973 (1996).
Glazebrook et al., *Proc. Natl. Acad. Sci. USA*, 91:8955 (1994).
Gordon-Kamm et al., *Plant Cell*, 2, 603 (1990).
Graham et al, *Biochem. Biophys. Res. Comm.*, 101:1164(1981).
Graham et al., *J. Biol. Chem.*, 260:6555 (1985).
Graham et al., *J. Biol. Chem.*, 260:6561 (1985).
Greene et al., *Science*, 231:1150 (1986).
Guerineau et al., *Mol. Gen. Genet.*, 262:141 (1991).
Gulyas and Farkas, *Phytopath. Z.*, 91:182 (1978)

Hammand-Kosack and Jones, *Ann. Rev. Plant Physiol. Plant Mol. Biol.*, 48:575 (1997).
Heinlein et al., *Science*, 270:1983 (1995).
Henikoff & Henikoff, *Proc. Natl. Acad. Sci. USA*, 89:10915 (1989).
Hiei et al., *Plant J.*, 6:271 (1994).
Higgins et al., *Gene*, 73:237 (1988).
Higgins et al., *CABIOS*, 5:151 (1989).
Hinchee et al., *Biotechnology*, 6:915 (1988).
Hoekema, In: *The Binary Plant Vector System*. Offset-drukkerij Kanters B. V.
Horvath and Chua, *Plant Mol. Biol.*, 31:1061 (1996).
Huang et al., *CABIOS*, 8:155 (1992).
Hudspeth & Grula, *Plant Molec. Biol.*, 12:579 (1989).
Huffman et al., *J. Cell. Biochem.*, 17B: Abstract.
Hunt et al., *Mol. Plant-Microbe Int.*, 9:261 (1997).
Ingelbrecht et al., *Plant Cell*, 1:671 (1989).
Innis et al., eds., *PCR Protocols: A Guide to Methods and Applications* (Academic Press, New York (1995).
Innis and Gelfand, eds., *PCR Methods Manual* (Academic Press, New York) (1999).
Jirage et al., *Proc. Natl. Acad. Sci. USA*, 96:13583 (1999).
Jobling et al., *Nature*, 325:622 (1987).
John et al., *Proc. Natl. Acad. Sci. USA*, 89(13):5769 (1992).
Jones et al., *Adv. Bot. Res.*, 24:89 (1997).
Joshi et al., *Nucleic Acid Res.*, 15:9627 (1987).
Joshi, *Nucl. Acid Res.*, 15, 6643 (197).
Karlin and Altschul, *Proc. Natl. Acad Sci. USA*, 87:2264 (1990).
Karlin and Altschul, *Proc. Natl. Acad. Sci. USA*, 90:5873 (1993).
Keegan et al., *Science*, 231:699 (1986).
Keller et al., *Genes Dev.*, 3:1639 (1989).
Klein et al., *Bio/Technology*, 6:559 (1988).
Klein et al., *Nature* (London), 327:70 (1987).
Klein et al., *Plant Physiol.*, 91:440 (1988).
Klein et al., *Proc. Natl. Acad. Sci. USA*, 85:4305 (1988).
Kohler et al., *Plant Mol. Biol.*, 29:1293 (1995).
Knauf, et al., Genetic Analysis of Host Range Expression by *Agrobacterium* In: *Molecular Genetics of the Bacteria-Plant Interaction*, Puhler, A. ed., Springer-Verlag, New York, 245. (1983).
Komari, *Plant Cell Reports*, 9:303 (1990).
Koziel et al., *Biotechnology*, 11:194 (1993).
Kridl et al., *Seed Science Research*, 1:209 (1991).
Kriz et al., *Mol. Gen. Genet.* 207:90 (1987).
Krysan et al., *Plant Cell*, 11:2283 (1999).
Kunkel, *Proc. Natl. Acad. Sci. USA*, 82:488 (1985).
Kunkel et al., *Methods in Enzymol.*, 154:367 (1987).
Lange et al., *Plant Sci.*, 142:133 (1999).
Langridge et al., *Cell*, 34:1015 (1983).
Lashbrook et al., *Plant Cell*, 6:1485 (1994).
Leister et al., *Proc. Natl. Acad. Sci. USA*, 95:370 (1998).
Liang et al., *Science*, 257:967 (1992).
Lindstrom et al., *Der. Genet.*, 11:160 (1990).
Liu et al., *Plant J.*, 8:457 (1995).
Liu and Whittier, *Genomics*, 25:674 (1995).
Lommel et al., *Virology*, 81:382 (1991).
Ly et al., *Science*, 287:2486 (2000).
Macejak et al., *Nature*, 353:90 (1991).
Mansson et al., *Gen. Genet.*, 200:356 (1985).
Martin and Paz-Ares, *Trends in Genetics* 13:67 (1997).
Martinez et al., *J. Mol. Biol.*, 208:551 (1989).
McBride et al., *Proc. Natl. Acad. Sci. USA*, 91:7301 (1994).
McCabe et al., *Bio/Technology*, 6:923 (1988).
McDowell et al., *Plant J.*, 22:523 (2000).
McDowell et al., *Plant Cell*, 10:1861 (1998).
McNellis et al., *Plant J.*, 14:247 (1998).
Meinkoth and Wahl, *Anal. Biochem.*, 138:267 (1984).
Messing & Vierra, *Gene*, 19:259 (1982).
Meyers et al., *Plant J.*, 20:317 (1999).
Mogen et al., *Plant Cell*, 2:1261 (1990).
Moore et al., *J. Mol. Biol.*, 272:336 (1997).
Munroe et al., *Gene*, 91:151 (1990).
Murray et al., *Nucleic Acids Res.* 17:477 (1989).
Myers and Miller, *CABIOS*, 4:11 (1988).
Nawrath and Metraux, *Plant Cell*, 11:1393 (1999).
Needleman and Wunsch, *J. Mol. Biol.*, 48:443 (1970).
Odell et al., *Nature*, 313:810 (1985).
Ohtsuka et al., *J. Biol. Chem.*, 260:2605 (1985).
Okamuro et al., *Biochemistry of Plants*, 15:1 (1989).
Otsuki et al., *Virology*, 50:45 (1972).
Pacciotti et al. *Bio/Technology*, 3:241 (1985).
Padgett and Beachy, *Plant Cell*, 5:577 (1993).
Parinov et al., *Plant Cell*, 11:2263 (1999).
Parinov and Sundaresan, *Current Opinion in Biotechnoloy*, 11:157 (2000).
Park et al., *J. Plant Biol.*, 38(4):365 (1985).
Paszkowski et al., *EMBO J.*, 3:2717 (1984).
Pearson et al., *Meth. Mol. Biol.*, 24:307 (1994).
Pearson and Lipman, *Proc. Natl. Acad. Sci.*, 85:2444 (1988).
Penninck et al., *Plant Cell*, 8:2309 (1996).
Perlak et al., *Proc. Natl. Acad. Sci. USA*, 88:3324 (1991).
Pieterse et al., *Plant Cell*, 10:1571 (1998).
Pieterse et al., *Plant Cell*, 8:1225 (1996).
Proudfoot, *Cell*, 64:671 (1991).
Quigley et al., *J. Mol. Evol.*, 29:412 (1989).
Ralston et al., *Genetics*, 119:185 (1988).
Reina et al., *Nucleic Acids Res.*, 18:6425 (1990).
Reina et al., *Nucleic Acids Res.*, 18:7449 (1990).
Riggs et al., *Proc. Natl. Acad. Sci. USA*, 83:5602 (1986).
Rochester et al., (1986).
Rommens et al., *Plant Cell*, 7:1537 (1995).
Ronald, *Curr. Opin. Plant Biol.*, 1:294 (1998).
Rossolini et al., *Mol. Cell. Probes*, 8:91 (1994).
Roth et al., *Nature Biotechnology*, 16:939 (1998).
Ruiz et al., *Plant Cell*, 10:937 (1998).
Ryals et al., *Plant Cell*, 8:1809 (1996).
Ryals et al., *Plant Cell*, 9:425 (1997)
Sambrook et al., *Molecular Cloning: A Laboratory Manual* (2d ed., Cold Spring Harbor Laboratory Press, Plainview, N.Y.) (1989).
Sanchez-Fernandez et al., *Mol. Gen. Genet.*, 258:655 (1998).
Sanfacon et al., *Genes Dev.*, 5:141 (1991).
Sanford et al., *Particulate Science and Technology* 5:27 (1987).
Schernthaner et al., *EMBO J.*, 7:1249 (1988).
Schindler et al., *Plant Cell*, 4:1309 (1992).
Schmitz and Rao, *Virology*, 248:323 (1996)
Schwob et al., *Plant J.*, 4:423 (1993).
Shah et al, *Mol. Plant-Microbe Interact.*, 10:69 (1997).
Shimamoto et al., *Nature*, 338:274 (1989).
Shirasu et al., *Plant Cell*, 9:261 (1997).
Shirasu et al., *Plant Cell*, 99:355 (1999).
Shulaev et al., *Plant Cell*, 7:1691 (1995).
Simpson, *Plant Mol. Biol.*, 19:699 (1985).
Skuzeski et al., *Plant Molec. Biol.*, 15:65 (1990).
Slater et al., *Plant Mol. Biol.*, 5:137 (1985).
Smart and Fleming, *J. Biol. Chem.*, 271:19351 (1996).
Smith et al., *Adv. Appl. Math.*, 2:482 (1981).
Smith et al., *Planta*, 168:94 (1986).
Song et al., *Science*, 270:1804 (1995).
Spencer et al., *Theor App Genet*, 79:625 (1990).
Speulman et al., *Plant Cell*, 11:1853 (1999).

Staswick et al., *Proc. Natl. Acad. Sci. USA*, 89:6837 (1992).
Staub et al., *EMBO J.*, 12:601 (1993).
Staub et al., *Plant Cell*, 4:39 (1992).
Stemmer, *Nature*, 370:389 (1994).
Stemmer, *Proc. Natl. Acad. Sci. USA*, 91:10747 (1994).
Sukhapinda et al. *Plant Mol. Biol.* 8:209 (1987).
Sullivan et al., *Mol. Gen. Genet.*, 215:431 (1989).
Sussman et al., *Plant Physiology*, 124:1465 (2000).
Svab et al., *Proc. Natl. Acad. Sci. USA*, 87:8526 (1990).
Svab et al., *Proc. Natl. Acad. Sci. USA*, 90:913 (1993).
Thomma et al., *Plant Physiol.*, 121:1093 (1999).
Thomma et al., *Proc. Natl. Acad. sci. U.S.A.*, 85:15107 (1998).
Tijssen, *Laboratory Techniques in Biochemistry and Molecular Biology-Hybridization with Nucleic Acid Probes*, part I chapter 2 "Overview of principles of hybridization and the strategy of nucleic acid probe assays" Elsevier, N.Y. (1993).
Tissier et al., *Plant Cell*, 11:1841 (1999).
Turner et al., *Molecular Biotechnology*, 3:225 (1995).
VanTunen et al., *EMBO J.*, 7:1257 (1988).
Vasil et al., *Biotechnology*, 11:1553 (1993).
Verduin, *J. Gen. Virol.*, 38:571 (1978).
Vernooij et al., *Plant Cell*, 6:959 (1994).
Visedo et al., *Physiologia Plantarum*, 78:218 (1990).
Vodkin, *Prog. Clin. Biol. Res.*, 138:87 (1983).
Vogel et al., *EMBO J.*, 11:157 (1992).
Walker and Gaastra, eds., *Techniques in Molecular Biology*, MacMillan Publishing Company, New York (1983).
Wandelt et al., *Nucleic Acids Res.*, 17:2354 (1989).
Waterman, M. S. Introduction to Computational Biology: Maps, sequences and genomes. Chapman & Hall. London (1995).
Weeks et al., *Plant Physiol.*, 102:1077 (1993).
Weissinger et al., *Annual Rev. Genet.*, 22:421 (1988).
Wenzler et al., *Plant Mol. Biol.*, 13:347 (1989).
Weymann et al., *Plant Cell*, 7:2013 (1995).
White et al., *Nucl Acids Res*, 18:1062 (1990).
Whitham et al., *P.N.A.S.*, (USA), 93:8776 (1996).
Whitham et al., *Cell*, 78:1101 (1994).
Willits et al., *Mol Plant-Microbe Interact*, 11:795 (1998).
Xie et al., *Science*, 280:1091 (1998).
Yamamoto et al., *Nucleic Acids Res.*, 18:7449 (1990).
Yang et al., *Plant Mol. Biol.*, 38:1201 (1998).
Yang & Klessig, *Proc. Natl. Acad. Sci. USA*, 93:14972 (2000).
Yu et al., *Proc. Natl. Acad. Sci. USA*, 95:7819 (1998).
Zhang et al., *Plant Cell Reports*, 15:68 (1995).
Zhang et al., *Proc. Natl. Acad. Sci. USA*, 94:4504 (1997).
Zhang et al., *Molecular Breeding*, 4:551 (1998).
Zhou et al., *EMBO J.*, 16:3207 (1997).
Zhou et al., *Plant Cell*, 8:2235 (1996).
Zhou et al., *Plant Cell*, 10:1021 (1998).

All publications, patents and patent applications are incorporated herein by reference. While in the foregoing specification this invention has been described in relation to certain preferred embodiments thereof, and many details have been set forth for purposes of illustration, it will be apparent to those skilled in the art that the invention is susceptible to additional embodiments and that certain of the details described herein may be varied considerably without departing from the basic principles of the invention.

SEQUENCE LISTING (1394 sequences)

SEQ ID NO: 1 - DNA, 1509 bp, Oryza sativa
atgggcagcttggacaccaaccccacggccttctccgccttccccgccggcgagggtgaaaccttccagccgctcaacgccgatgatgtccggtcctacctccacaaggcggtggacttcatctcggactactacaagtccgtggagtccatgccggtgctgcccaatgtcaagccggggtacctgcaggacgagctcagggcctcgccgccgacgtactcggcgccgttcgacgtcaccatgaaggagctccggagctccgtcgtccccgggatgacgcactgggcgagccccaacttcttcgcgtttttcccctccacgaatagtgcggccgccattgccggcgacctcatcgcgtcggcgatgaacacggtcgggttcacgtggcaggcgtcgccggcggccaccgagatggaggtgctcgcgctggactggctcgcgcagatgctcaacctgccgacgagcttcatgaaccgcaccggcgaggggcgtggcaccggcggtggggttattctggggacgaccagcgaggcgatgctcgtcacgctcgttgccgcgcgcgacgccgcgctgcggcggagcggcagcgacggcgtggcgggactccaccggctcgccgtgtacgccgccgaccagacgcactccacgttcttcaaggcgtgccgcctcgccgggtttgatccggcgaacatccggtcgatccccaccggggccgagaccgactacggcctcgacccggcgaggctgctggaggcgatgcaggccgacgccgacgccgggctggtgcccacctacgtgtgcgccacggtgggcaccacgtcgtccaacgccgtcgacccggtgggcgccgtggccgacgtcgcggcgaggttcgccgcgtgggtgcacgtcgacgcggcgtacgccggcagcgcgtgcatctgcccggagttcaggcaccacctcgacggcgtggagcgcgtggactccatcagcatgagcccccacaaatggctgatgacctgcctcgactgcacctgcctctacgtgcgcgacacccaccgcctcaccggctccctcgagaccaacccggagtacctcaagaaccacgccagcgactccggcgaggtcaccgacctcaaggacatgcaggtcggcgtcggccgccgcttccgggggctcaagctctggatggtcatgcgcacctacggcgtcgccaagctgcaggagcacatccggagcgacgtcgccatggccaaggtgttcgaggacctcgtccgcggcgacgacaggttcgaggtcgtcgtgccgaggaacttcgctctcgtctgcttcaggatcagggccggcgccggcgccgccgccgcgacggaggaggacgccgacgaggcgaaccgcgagctgatggagcggctgaacaagaccggcaaaggcgtacgtggcgcacacggtggtcggcggcaggaagagcatcacgtgcggagcgcgtgggagctcatcaagaagacgaccaccgagatgatgaactaa

SEQ ID NO: 2 - protein, 502 aa, Oryza sativa
MGSLDTNPTAFSAFPAGEGETFQPLNADDVRSYLHKAVDFISDYYKSVESMPVLPNVKPGYLQDELRASPPTYSAPFDVTMKELRSSVVPGMTHWASPNFFAFFPSTNSAAAIAGDLIASAMNTVGFTWQASPAATEMEVLALDWLAQMLNLPTSFMNRTGEGRGTGGGVILGTTSEAMLVTLVAARDAALRRSGSDGVAGLHRLAVYAADQTHSTFFKACRLAGFDPANIRSIPTGAETDYGLDPARLLEAMQADADAGLVPTYVCATVGTTSSNAVDPVGAVADVAARFAAWVHVDAAYAGSACICPEFRHHLDGVERVDSISMSPHKWLMTCLDCTCLYVRDTHRLTGSLETNPEYLKNHASDSGEVTDLKDMQVGVGRRFRGLKLWMVMRTYGVAKLQEHIRSDVAMAKVFEDLVRGDDRFEVVVPRNFALVCFRIRAGAGAAAATEEDADEANRELMERLNKTGKGVRGAHGGRRQEEHHVRSAWELIKKTTTEMMN

SEQ ID NO: 3 - DNA, 1624 bp, Oryza sativa
atgctgctggcggcggcgagcgcgtcgcggccgtcgtcgtcgctggaagggttccagccgctgtcgaagatcgccgtccacaaggccaccccttccgctgacgactggattgctgtcttctctccggccgatttccaattcgcaaactactcggcgaactacgtgtactggggcaagggcagcatccggttccagctcatcaaccagcgctacgacttctccttcgccctgttcaccggcggcctggaaaaccctaagctggtggcggtgtcggaggcgatatcgttcaagaaccccaaggcgccggtgtaccctcggctggcgcagggcaagtcgtacgacgagatgaccgtcacatggaccagcggctacgacatcagcgaggcgtacccgttcgtcgagtggggcatggtcgtcgccggcgccgccgctccaacccgcaccgccgccggcacgctcaccttcaaccgcggcagcatgtgcgggtgagccggcacgcactgttgggtggagagaccccgggttcatccacacagctttcctgagagacctgtggcccaacaaagagggcatgaactttctgacggatcaattgtctggggcaagcaatacactttccgggcgccacccttccctggccagaactcgctgcaacgcatcatcgtcttcggcgacatgggcaaggcggagagagacggatcaaacgagttcgccaactaccagccaggatctctgaacacgacggacaggctggtcgaggatctggacaactacgacattgtcttccacatcggtgatcttccgtacgccaatggctacatctcccagtgggaccagttcaccgcccaggtcgcccccatcaccgccaagaagccctacatgattgcaagagcggtaaccatgagagggactggcccaacaccggagggttcttcgacgtcaaggactccggcggcgagtgcggcgttccggcagagaccatgtactactacccggccgagaatcgagccaacttctggactacgggatgttccggttctgcatcgcggactcggagcacgactggagggagggtaccgaccagtacaagttcatcgagcagtgcctgtcgacggtggaccggaagcaccagccgtggctcatcttcgcggcgcaccgcgtgctgggctactcctccaactggtggtacgccgaccagggctccttcgaggagcccgaagggagggagagcctgcagcggctgtggcagcgccaccgcgtcgacgtcgccttcttcggccacgtccacaactacgagcggacgtgcccgatgtaccagagccagtgcgtctccggcgagaggcgccgctactccggcaccatgaacggcaccatcttcgtcgtcgccggcggcggcgggagccacctctcggactacacctcggcgatccccaagtggagcgttttcagggaccgggacttcgggttcgtcaagctcaccgcgttcaaccactcgtcgctgctgttcgagtacaagaagagcagcgatgggaaggtgtatgactccttcaccgtggagagggattaccgcgacgtgctcagctgcgtgcacgacagctgcctccccaccacgctcgcctcctga

SEQ ID NO: 4 - protein, 540 aa, Oryza sativa
  misc_feature (163)..(163): Xaa = any naturally occuring amino acid
MLLAAASASRPSSSLEGFQPLSKIAVHKATPSADDWIAVFSPADFQFANYSANYVYWGKGSIRFQLINQRYDFSFALFTGGLENPKLVAVSEAISFKNPKAPVYPRLAQGKSYDEMTVTWTSGYDISEAYPFVEWGMVVAGAAAPTRTAAGTLTFNRGSMCGXAGTTVGWRDPGFIHTAFLRDLWPNKEGHELSDGSIVWGKQYTFRAPPFPGQNSLQRIIVFGDMGKAERDGSNEFANYQPGSLNTTDRLVEDLDNYDIVFHIGDLPYANGYISQWDQFTAQVAPITAKKPYMIASGNHERDWPNTGGFFDVKDSGGECGVPAETMYYYPAENRANFWTYGMFRFCIADSEHDWREGTDQYKFIEQCLSTVDRKHQPWLIFAAHRVLGYSSNWWYADQGSFEEPEGRESLQRLWQRHRVDVAFFGHVHNYERTCPMYQSQCVSGERRRYSGTMNGTIFVVAGGGGSHLSDYTSAIPKWSVFRDRDFGFVKLTAFNHSSLLFEYKKSSDGKVYDSFTVERDYRDVLSCVHDSCLPTTLAS

SEQ ID NO: 5 - DNA, 171 bp, Oryza sativa
atggatgtggttgccatagtggtagttgatggtgctggcgaacatctatgtgaattcatggattcatcatctcggctacgggtgcctagcatgtacaagcataggggccagagtgatcgatcaccgaacagcatttccggtactgatgcacctatcttactaccaaattga

SEQ ID NO: 6 - protein, 56 aa, Oryza sativa
MDVVAIVVVDGAGEHLCEFMDSSSRLRVPSMYKHRGQSDRSPNSISGTDAPILLPN

SEQ ID NO: 7 - DNA, 307 bp, Oryza sativa
atgatcggtgtggttttcaaccgtttgtttttttttgcgtttgcaggtgctctccaacgacatcgacctgctgaacccgcccgcggagctggagaagctcaagcacaagaagaagcgcctcgtccagtcccccaactccttcttcatgtttgcaggatgtcaagtgccagggctgcttcagcatcactactgtgttcagccactcccagacagtggtggtctgcccgggctgccaaaccgtgctttgccagcctacaggtggaaaggccaggctaacggaggggtgctccttccgccgcaagaatga

SEQ ID NO: 8 - protein, 101 aa, Oryza sativa
  misc_feature (1)..(1): Xaa = any naturally occuring amino acid
XSVWFSTVCFFLRLQVLSNDIDLLNPPAELEKLKHKKKRLVQSPNSFFMFADVKCQGCFSITTVFSHSQTVVVCPGCQTVLCQPTGGKARLTEGAPSAARM

SEQ ID NO: 9 - DNA, 1356 bp, Oryza sativa
atggcagaagcaatcttctcggcaattgttggcgatgtgatcggcagagtgatatcccttgttgtcagtaatttcaatggagatcacagcactgaagtcaagttacagaggatatgccgcatgctgatcaagatccatagcgtagttgaggaggccaaagggaggcagatcaccaaccatggcaccctcgagtggctctcggagctcatcgatggcgcataccaaggccgttacttgctcgacacgatcggatgcggggagcctgatcttgatgacaagaatcgcgatgaggtagatcccaagcctttctccttgtccaagttcaatcctgcaaagcgtgtgcgcgtcgcggctttcaccgtgaggaacatactgtctcgccacgacatcggtgttgatgagattgatagggtggttgagagcttgcagagcatgtgtggtgatctcaaggagttcatgatgctccttcaggcctgccagccgattcatcggcctctagctaccaacatcttcatcgaggggcagatgttcggccgacatgtcaaaaaggagatgatcatcaacttcttgctgcatgaggatgatctaccaagaggaaaacttggtgttcttccgattctaggcgatatcggggtcgggaagaccaccctagtacagcatgcctgtgatgatgctagggtgcgcagccacttcacaacaatcttgctgttcaatttctcacacacctacaagatggagatgtgtgaaccaaagcctgttctacggcctaaacatgtcatcggagatgttggaaattcagatgatccactacatgaactggagcagagtttcttcaacaagaggttcttgattgttttcgaggatgttgacatacacaagaagaacatgcttgaggagctcctgaaaagcctgagttgtggcaaacaaggtagcaagatcatagtcacaaccagcaacaagcatgtcactacaattggaacagtgcagcctatcaaactgaagtttttgccctgcccagagtactggttcttcttcaaagcgcatgccttcgccggcacagatgtccaggagaaccctaggctgagagatattggggggctgtcattgttgggtgatggacttggctacattgctgatttagtggaaattttgctgccaagtcgcctatccgtgaaggaggtcttcgtctccaagaactcattgtcctctgagacagagttggctaggctgcagggggtgctcggctgcactggctgcaattgtagccgcaactgcgcagctgccacagccaaggcctcgcagcaggccccttggatgcagaaagcaataatggttatacaaaggacaatcatctag

SEQ ID NO: 10 - protein, 451 aa, Oryza sativa
MAEAIFSAIVGDVIGRVISLVVSNFNGDHSTEVKLQRICRMLIKIHSVVEEAKGRQITNHGTLEWLSELIDGAYQGRYLLDTIGCGEPDLDDKNRDEVDPKPFSLSKFNPAKRVRVAAFTVRNILSRHDIGVDEIDRVVESLQSMCGDLKEFMMLLQACQPIHRPLATNIFIEGQMFGRHVKKEMIINFLLHEDDLPRGKLGVLPILGDIGVGKTTLVQHACDDARVRSHFTTILLFNFSHTYKMEMCEPKPVLRPKHVIGDVGNSDDPLHELEQSFFNKRFLIVFEDVDIHKKNMLEELLKSLSCGKQGSKIIVTTSNKHVTTIGTVQPIKLKFLPCPEYWFFFKAHAFAGTDVQENPRLRDIGGLSLLGDGLGYIADLVEILLPSRLSVKEVFVSKNSLSSETELARLQGVLGCTGCNCSRNCAAATAKASQQAPWMQKAIMVIQRTII

SEQ ID NO: 11 - DNA, 717 bp, Oryza sativa
  misc_feature (166)..(166): k = guanine or thymine
  misc_feature (172)..(172): s = guanine or cytosine
  misc_feature (177)..(177): y = cytosine or thymine
  misc_feature (183)..(183): s = guanine or cytosine
  misc_feature (229)..(229): k = guanine or thymine
atggcagcctacgggaagccgcagccgccgctgaacgacgcgtactacggcccgccgatcccgccgccaccggcggcagcgtactacggcgcagcggcgcctccgcccgcgccacgccggagcggcgcgcaccgtctgttctgctgcctcttcagggtgctcgccktcgccsttatygcgctsggaaccgccgtcctcgtcctctggctcatctaccgccccagcgtcktcaaggcctacgccgaaaccgctgcgctgtcccgcttcgacctcaccaacggcggcagcctcctcgtgtacaacctcaccgtgggcatgcgcgtgcgcaaccccaaccgcttcggcatcaacttcaggagcgtcgacgcgcaggcgtcctacgacggcgaccggttcgggtacgcgccgctgcagccgttatacgttggtcggaagagcgacgccaggttcgacgtgacgctgagcggctcggcggccatcgacgaccgcgacgtggagcgcacataccggagggagacggcgcaggggtcttacgaggttaaggtcagggtgtacgctagacaaggattcaaggtcaggggcttcaggctgaacaacaagagcaaattcacctgcacgctgaacctgccggcgcccaactccggcaacggcaccgcgagcgggacgccgacgacggtgttcacgaggaagcagccgaagtgcgacgtggactattga

SEQ ID NO: 12 - protein, 238 aa, Oryza sativa
MAAYGKPQPPLNDAYYGPPIPPPPAAAYYGAAAPPPAPRRSGAHRLFCCLFRVLALALIALGTAVLVLWLIYRPSVLKAYAETAALSRFDLTNGGSLLVYNLTVGMRVRNPNRFGINFRSVDAQASYDGDRFGYAPLQPLYVGRKSDARFDVTLSGSAAIDDRDVERTYRRETAQGSYEVKVRVYARQGFKVRGFRLNNKSKFTCTLNLPAPNSGNGTASGTPTTVFTRKQPKCDVDY

SEQ ID NO: 13 - DNA, 501 bp, Oryza sativa
atgccgccgaagctcgacccgacgcaggtggtggatgtgttcgtccgcgtgaccggaggcgaggtgggcgcggcgtcgtcccttgcccccaagatcggccctctcggtctctcccccaagaagatcggtgaggacatcgccaaggagacggccaaggactggaagggcctccgcgtcaccgtcaagctcaccgtccagaaccgtcaggcgaaggtgtccgtcgtcccctccgccgcggcgctcgtcatcaaggccctcaaggagcccgagcgggacaggaagaaggtcaagaacatcaagcacagtggtaacatcagcctcgacgacgtcatcgagatcgccaggatcatgaggaacaggtccatggccaaggagatggccgggaccgtcaaggagatccttgggacctgcgtcagcgttgggtgcaccgtcgacggcaaggaccccaaggatctgcagcaggagatctccgatggcgaggtcgagatcccttcggcttaa

SEQ ID NO: 14 - protein, 166 aa, Oryza sativa
MPPKLDPTQVVDVFVRVTGGEVGAASSLAPKIGPLGLSPKKIGEDIAKETAKDWKGLRVTVKLTVQNRQAKVSVVPSAAALVIKALKEPERDRKKVKNIKHSGNISLDDVIEIARIMRNRSMAKEMAGTVKEILGTCVSVGCTVDGKDPKDLQQEISDGEVEIPSA

SEQ ID NO: 15 - DNA, 894 bp, Oryza sativa
atggctgctaataagctcaagttctcccctctccttgccctcttcctcctggccggcatagccgtaacctcccgtgccggcgacatcgccgtgtactggggccagaacggcgacgagggcagcctggccgacgcctgcaactccggcctatacgcgtacgtcatggtcgccttcctcagcaccttcggcaacggccagacccctgtcctcaacctcgccgggcactgcgaaccaagctccggcggctgcaccggccagagctcggacatccagacgtgccagtcgctgggcgtcaaggtcatcctgtccatcggcggcggcgccggcagctacgggctgtcgtccacccaggacgcccaggacgtggccgactacctgtggaacaacttcctcggcggcagctcgggctcccggccgctcggcgacgccgtgctggacggcgtcgacttcgacatcgagaccggcaacccggcgcactacgacgagctcgccacgttcctgtcgcggtacagcgcgcaggggggcggcaagaaggtgatcctgacggcggcgccgcagtgcccctacccggacgcgtcgctggggccggcgctgcagacggggctgttcgacagcgtgtgggtgcaattctacaacaacccgccgtgccaagttacgccaacggcgacgccagcaacctggtgagcgcgtggaacacgtggaccggcggcgtcagcgccgggagcttctacgtcggcgtgccggcggcggaggccgcggcggggagcgggtacgtggcacccggcgacctgacgtcggcggtgctccccgccgtgcagggcaacgccaagtacggcggcatcatggtgtggaaccggttctacgacgtgcagaacaacttcagcaaccaggtga

SEQ ID NO: 16 - protein, 297 aa, Oryza sativa
MAANKLKFSPLLALFLLAGIAVTSRAGDIAVYWGQNGDEGSLADACNSGLYAYVMVAFLSTFGNGQTPVLNLAGHCEPSSGGCTGQSSDIQTCQSLGVKVILSIGGGAGSYGLSSTQDAQDVADYLWNNFLGGSSGSRPLGDAVLDGVDFDIETGNPAHYDELATFLSRYSAQGGGKKVILTAAPQCPYPDASLGPALQTGLFDSVWVQFYNNPPCQYANGDASNLVSAWNTWTGGVSAGSFYVGVPAAEAAAGSGYVAPGDLTSAVLPAVQGNAKYGGIMVWNRFYDVQNNFSNQV

SEQ ID NO: 17 - DNA, 1182 bp, Oryza sativa
atggcgggaaaaggaggtaagggcttgctcgccgcgaagacgacggccgccaagtcggcggagaaggacaaggggaagaaggcccccgtctcccgctcgtcccgcgctggtctccaggaaggtggtagtatgccagtggcaccaactgtggtggtttcagctaccatggaagccaaccatgataggactctgttccctgttggccgtatccatcgccagttgaagcaaaggactcaggcaaatggacgtgttggtgctactgccgcagtttactctgctgctattctggagtacttaacagctgaggttctggaactggctgggaacgctagcaaggatctgaaggtcaagcgtatcacccctcgccatctgcagcttgccatccgtggagatgaggagctcgacactctcatcaagggtaccatcgctggtggagtggtcaagagctttgttttctttgtcacttttcattattttacactccaggctgactggatccagcatagatatacggtacgtggaggatggtctactactcaaatccgagctaaagctactaaccctaatgaaaggttatcattctgttccaagtcaattcttgcatcaataaccaatacaagttgcccccctgctgtttatccccagaaacttacttaccctttactttcacccttggctgtcattcagtggtgtgactgtgaaggtggcggagcctgcatggaagggctgacgagcgagcagatggtggcgttccaggaggcgttcttgctcttcgacaagaacggcgatggatgcatcaccttggaagagctggctgcggtgactcgttctcttggccttgagccgaccgatcaggagctcaacgacatgatgagggaagttgatacagatggcaatgggatcatagattttcaggagttcctgagcctcattgccaggaagatgaaggatggggatggcgacgaagagctgaaagaagctttcgaggtcctagacaaggatcagaatggttttatctccccaactgagctgaggacagtgatgaccaatcttggggagaagatgacagacgaggaggttgagcagatgataagggaggcggataccgatggcgacgggcaggtgaactacgatgaatttgtgataatgatgaaaaacgctgaacggaagatatctgggtga

SEQ ID NO: 18 - protein, 393 aa, Oryza sativa
MAGKGGKGLLAAKTTAAKSAEKDKGKKAPVSRSSRAGLQEGGSMPVAPTVVVSATMEANHDRTLFPVGRIHRQLKQRTQANGRVGATAAVYSAAILEYLTAEVLELAGNASKDLKVKRITPRHLQLAIRGDEELDTLIKGTIAGGVVKSFVFFVTFHYFTLQADWIQHRYTVRGGWSTTQIRAKATNPNERLSFCSKSILASITNTSCPPAVYPQKLTYPLLSPLAVIQWCDCEGGGACMEGLTSEQMVAFQEAFLLFDKNGDGCITLEELAAVTRSLGLEPTDQELNDMMREVDTDGNGIIDFQEFLSLIARKMKDGDGDEELKEAFEVLDKDQNGFISPTELRTVMTNLGEKMTDEEVEQMIREADTDGDGQVNYDEFVIMMKNAERKISG

SEQ ID NO: 19 - DNA, 684 bp, Oryza sativa
atggaggcgtggaagcgaagatctgggtgcctcaccggagaagcaaaaccggtgacgtcgttctcggccctcgtcggcggcggcggcggcggtcgccgtcgcgacgccgtggagaatgacttggctatggaccgtgaggcactgagactgacatgtggggagagactgacaggtgggaccggattctgcacaagtaagtgggtcccacacgtcagtgaccgccgcgatgactgggctttgcctcgagagtcggcaacacactctactacacccttcgacgactcgagatcgagagacgcgagcgcgactctcctcccaggcggcggccaagttttcttcctcgctgtaagcttggttccgtgtggtcccggtagatttatgctgttcttgagcgttgaatcggtagggggatggatacacgggggcgctagggttcaagatgcttacgagatcttgtgcgatccagttatggggaattctgttgacatgatctccactccccaaatcccagatccagttagtcagttacgcgctgacgtgactgacatatgctttctacctttgttgcagatgtttgacgatcaagacttgggtttctttgccaatttcttgggcatcttcatatttgtcttggtcatcgcttaccactttgtgatggcagacccgaagtatgagggaaactga

SEQ ID NO: 20 - protein, 227 aa, Oryza sativa
MEAWKRRSGCLTGEAKPVTSFSALVGGGGGGRRRDAVENDLAMDREALRLTCGERLTGGTGFCTSKWVPHVSDRRDDWALPRESATHSTTPFDDSRSRDASATLLPGGGQVFFLAVSLVPCGPGRFMLFLSVESVGGWIHGGARVQDAYEILCDPVMGNSVDMISTPQIPDPVSQLRADVTDICFLPLLQMFDDQDLGFFANFLGIFIFVLVIAYHFVMADPKYEGN

SEQ ID NO: 21 - DNA, 558 bp, Oryza sativa
  misc_feature (54)..(54): y = cytosine or thymine
  misc_feature (56)..(56): s = guanine or cytosine
  misc_feature (59)..(59): s = guanine or cytosine
atgaagaccgccatgactacttccacccttctcttcctcctcctcgccggcctyascgscgccgccctcggcacggcggacgacgacaccaccaccaacaccatacgcctcccgaccgacggaggatcagcacagcaggcgccgacgaagaagaagccgtggaagtgctgcgacaacatcgagcggctgccgacgaagaccaacccgccgcagtggcgctgcaacgacgagctggagcccagcaagtgcgtggcacagtgcgaggtgtgccaggaggcgccggggccattcccgggcccgctcatctgcagcgacgtctactggggcgccgacccgggtcccttctgcacgccgcggccgtggggagattgctgcaccaacaccacctgcaccaggtcgatcccgccgatctgccgctgcaacgacaaggtgaagaagtgcgccgccgcgtgcaaggattgcaagcgggtgaagtcgtcgaagcctcctcgctacgtctgccaggaccagttcaccggccagccagggcccaagtgcaaacactcgtgcgagaactag

SEQ ID NO: 22 - protein, 185 aa, Oryza sativa
MKTAMTTSTLLFLLLAGLTAAALGTADDDTTTNTIRLPTDGGSAQQAPTKKKPWKCCDNIERLPTKTNPPQWRCNDELEPSKCVAQCEVCQEAPGPFPGPLICSDVYWGADPGPFCTPRPWGDCCTNTTCTRSIPPICRCNDKVKKCAAACKDCKRVKSSKPPRYVCQDQFTGQPGPKCKHSCEN

SEQ ID NO: 23 - DNA, 676 bp, Oryza sativa
atggggagcttcgcgaggaaggagcaccagttcctcgccgagcttggcctcgcgccgcggaaccccgggtccttcgcctgcggcgcctggggcggctcgggccccgtcgtcacgtccaccaacccgacgaacaaccaggaggtcatcgcggaggtcgtggaggcgtccgcgcgtgagtacgaggagggcatgcgcgcctgctacgatgccgccaagacctggatggcgaggaaatcattgacatgtgtgattatgctgtgggcctaagtcgccagctaaatgggtccatcataccatctgaacgcccgaatcatatgatgatggagaggtgtggaatcctcttggagttgttggtgttatcacagcattcaattttccttgtgctgtgctggttaggttggaatgcctgcatagctttggtatgtggaaactgtgttgtctgcagaatctgaaggaagcagttgaaatcaacaattctgttcctcaaggattgagcagttctatatttacaaagagaccagatattattttcaagtggattgggtacgatcaactatggaagcgagctgcctctagcacaaggaataaattttggctagttcggtggtcaagatcggctgatgaacatgttaagcttcatcgacagacttcaggaatttctactggcgtcaactga

SEQ ID NO: 24 - protein, 149 aa, Oryza sativa
  misc_feature (49)..(49): Xaa = any naturally occuring amino acid
VRGGHARLLRCRQDLDGEEIIDMCDYAVGLSRQLNGSIIPSERPNHMMXGEVWNPLGVVGVITAFNFPCAVLLGWNACIALVCGNCVVCQNLKEAVEINNSVPQGLSSSIFTKRPDIIFKWIGTINYGSELPLAQGINFGCGNCVVCRI

SEQ ID NO: 25 - DNA, 340 bp, Oryza sativa
atggcggcgaggacggtggcggtggcggcggcgctcgccgtgctgctgattttcgccgcctcgtcggcgaccgtggccatggccggccggccaacgcctacgacgtctctcgacgagaggaagcggctcaggcggcggcgcagtcggagatcggcggcgggtgcaaggaaggggaaggggaggaggagtgcctcgcgaggaggacgctgacggcgcacaccgattacatctacacccagcagcatcacaactaattaatcttatcgatcaatcaataatcaatcaatcaatcagtcgcttcctcttcgatctaccaatactagtattggtatataattaa

SEQ ID NO: 26 - protein, 67 aa, Oryza sativa
  misc_feature (11)..(11): Xaa = any naturally occuring amino acid
  misc_feature (25)..(25): Xaa = any naturally occuring amino acid
  misc_feature (35)..(35): Xaa = any naturally occuring amino acid
SSRGTPPPLPXSLHPPPISDCAAAXAASSRRETSXALAGRPWPRSPTRRRKSAARRAPPPPPPSSPP

SEQ ID NO: 27 - DNA, 1632 bp, Oryza sativa
atggcggaggaagatggagtggagagaggggaggaggagttggccaccgacgaggtccactctggtggcggcggagaagaggggtatcaggctggtctaggtaccaggtatatgatacctaggtacccaacgtactcagatggtaccaggtatctgataccccaggtactcgatgccctataccagatctggtacctatgggattcatgccgatctaggtaccaggtacccgatgcccagtaccagatctggtacctatgggattcatgccgatctaggtaccaggccctcatgccgatgggagctatgagaaaaagggaaaagagacgaggcaagcacaaaaataagatggctatcttccttggaggtggaagaacactattccttcttgttgccatccttgattcggatcgccgctgctacatcctcgacacgcatgtgaccatgatgtacacgagagttcccatgaccaccatcaacgatgtgatgttccgcacaacgagagctaacaccgctctgggagagaggcgtagaggaggagaggcgaaggaggaggacgaccaagcaaagctccgggagagagagagctccacctcgacggcggtgaacaccacgaacagctccgggccatcacggtgttcgtcgtcggtctccaagaacctggcgatgcaggaacctgccgacgaggtccgtggcagagagaggaccatgccactgccatcactagccggtgagaggccgtgctccgggacgtactcggcgaggccgccgatcgaacggcagcgtccagtcgtcggcggcgcgccgtgtcgaagcgcgctagtcctcgccgccgtggtcatcgtaggcgtagatgagcccatggaagcaaccaccggcgaccggcgaatccgaggcgttgaggcagattgtttatctggcatcctggccccgcctgccatagactcatcggtctctggccccacctgtcatagactcatccgcttctctctgctcgttagttgccttcgtcctcctgccgcctcgggtgttcttccttcctccatcgccatggcggcggcggcggcttcccaccgcgtgttcgtctacgggacgctaatggcggaggaggtggtgcgcgtcctcatcggccgctcgccgtcctcctccccggccgtcctcccaaaccagtccgtccacgagacatctgtttcttcttcttcttcttgccaagaatcccctcctctctgctgcgaaattctgatcggccaccgtctcctgcagccagaggttcagcatcaaggggcgcgtttacccggcgattcttcccgtcgacggcaaggaggtctcagggaaggtaagcccctcttgcttcctctctcggttttcaagggcatcactgacagggagctcaatgtgctggatatatttgaagatgaggagtatgtcaagagaaccgttgagatatcactaactgacacatcggagaaattgcttgcttatgcatacatttggggcaatcaggatgatcctgacctctatggtgaatgggactttgaggaatggaaaagggtgcacttggaggattatgtcaagatgacacaagagttcatggaggaactggaacagctcgaaccaaagaccgagacctga

SEQ ID NO: 28 - protein, 543 aa, Oryza sativa
MAEEDGVERGEEELATDEVHSGGGGEEGYQAGLGTRYMIPRYPTYSDGTRYLIPQVLDALYQIWYLWDSCRSRYQVPDAQYQIWYLWDSCRSRYQALMPMGAMRKREKRRGKHKNKMAIFLGGGRTLFLLVAILDSDRRCYILDTHVTMMYTRVPMTTINDVMFRTTRANTALGERRRGGEAKEEDDQAKLRERESSTSTAVNTTNSSGPSRCSSSVSKNLAMQEPADEVRGRERTMPLPSLAGERPCSGTYSARPPIERQRPVVGGAPCRSALVLAAVVIVGVDEPMEATTGDRRIRGVEADCLSGILAPPAIDSSVSGPTCHRLIRFSLLVSCLRPPAASGVLPSSIAMAAAAASHRVFVYGTLMAEEVVRVLIGRSPSSSPAVLPNQSVHETSVSSSSSCQESPPLCCEILIGHRLLQPEVQHQGARLPGDSSRRRQGGLREGKPLLLPLSVFKGITDRELNVLDIFEDEEYVKRTVEISLTDTSEKLLAYAYIWGNQDDPDLYGEWDFEEWKRVHLEDYVKMTQEFMEELEQLEPKTET

SEQ ID NO: 29 - DNA, 240 bp, Oryza sativa
atggtcagcaggcttactgccacttgccgagttgctaaagatttaacctattggttattgggaccggaccggaccggcggttggaccggaaaaaaccggaaccaaggcctctgccggttcggtccagttaaaagattgtatgtgcaaatgacccggtataaaccggttgggccggccgggtttattcgaaaaccgcttaaaagccggtcagaaaaccggcgcaggaccactcaaccgtga

SEQ ID NO: 30 - protein, 79 aa, Oryza sativa
MVSRLTATCRVAKDLTYWLLGPDRTGGWTGKNRNQGLCRFGPVKRLYVQMTRYKPVGPAGFIRKPLKSRSENRRRTTQP

SEQ ID NO: 31 - DNA, 1166 bp, Oryza sativa
  misc_feature (76)..(76): k = guanine or thymine
atgggtgacctgggaggagcctggcatgaggcggccgcggcggaggaggaggaggcacaggcaccgggcggcggcktcgggcccgagcccgaccacctggtggtcatggtccacgggatcgtcgggagagtgcagctgattggaagtttggagctgagcaatttgaaaagttgctgtcagacaaagttatagttcatcgtagcaatcgcaacatgtacaagctaactttagatggcgttgatgtgatgggtgagcggttggcacaagaggttgaagaaaccaacaaaagaccacagatcagaaagatctcttttgttgcacattctgttggaggattggttgcaagatatgctattggaagactctataggccacctaaacaaacatcccaaagttctcagaatctgaacaacactaataagggtactatacatgggcttgaggcagtgaacttcataactgttgcgtcaccgcatcttggttctagaggaaacaaacagaatccgcaggttcctttcctttttggatttactgcaatagaaacttttgccagctacatcattcatttgatattcggaaaaactggcaagcatctatttcttatggacaatgatgatgggaagcctccattgttgctacgcatggtggatgattgggggggcgtacagttcatttgctatttcagtggactgattcaggaagcaagatttacccacatattgtatatgaagaactatccaaagcagaaacaatgaatcaatgtactgatgttgccgatgtggacagctgcatgttagaaggaacggcttttaagaggtctgaagcttgtgtcgtgggaaaaggtggatgtcagcttccacaacagcaaagtaagatctgcagcacatagtgtgattcagcgaaggtgccgatgtcataaaccatatgatcgaccatttcgtcctatagtaaaacagctccgatatctagaagcaagcttgagcgaggaacgtcagttgctaactgctgatttgccgagcctgaaattttggtccggatatgcgagtattgttggcacttgttgggaatacaacggcaacgcgtattcgtaaccggctaaataagaaaaaaaagcatatcaaacgtcagctagtaaatttaatagtcactttgttttggatgattaa

SEQ ID NO: 32 - protein, 362 aa, Oryza sativa
  misc_feature (26)..(26): Xaa = any naturally occuring amino acid
MGDLGGAWHEAAAAEEEEAQAPGGGXGPEPDHLVVMVHGIVGSAADWKFGAEQFEKLLSDKVIVHRSNRNMYKLTLDGVDVMGERLAQEVEETNKRPQIRKISFVAHSVGGLVARYAIGRLYRPPKQTSQSSQNLNNTNKGTIHGLEAVNFITVASPHLGSRGNKQNPQVPFLFGFTAIETFASYIIHLIFGKTGKHLFLMDNDDGKPPLLLRMVDDWGGVQFILLFQWTDSGSKIYPHIVYEELSKAETMNQCTDVADVDSCMLEERLLRGLKLVSWEKVDVSFHNSKVRSAAHSVIQRRCRCHKPYDRPFRPIVKQLRYLEASLSEERQLLTADLPSLKFWSGYASIVGTCWEYNGNAYS

SEQ ID NO: 33 - DNA, 852 bp, Oryza sativa
atgttgttatttgtgctgatcatttccttttcccttaccgtaataccaggcaaggggtttgaagaagcatctgaagaggctcaatgcgcccaagcattggatgctcgacaagcttggtggagcttttgcccccaagccatcttctggtcctcacaagtccagggaagtgcctgcctctgatcctcattatcaggaacaggctcaagtatgctctgacataccgtgaggttatttctatcctcatgcagcgccatgtcttggttgatggcaaggtcaggactgacaagacctacccagctggtttcatgggatgtcatttccatccccaagactggtgagaactacaggcttctgtacgacaccaagggacgtttccgccttcagtctgtcaaggatgaggatgctaaggcacagtttaagctttgcaaggttcggtctgtgcagtttggccagaagggaatcccctacctgaacacctatgatggtcgcaccatccgctaccctgacccgatcatcaaggcaaacgacacaatcaagatcgatctggagaccaacaagattgtcgacttcatcaagtttgatgttggcaatgttgtcatggtgactggaggaaggaacacaggccgtgttggtgtgatcaagaacagggagaagcataaaggcagcttcgagaccatccacgttgaggatgccctgggccaccaattcgccacccgtctgggcaatgtgttcaccattggcaagggcaacaagccttgggtgagcctgcccaagggcaagggcatcaagctcagcatcatcgaggagcaaaggaagcgggatgctgccgcccaggctgctgccaacgcttaa

SEQ ID NO: 34 - protein, 282 aa, Oryza sativa
VVICADHFLFPYRNYQARGLKKHLKRLNAPKHWMLDKLGGAFAPKPSSGPHKSRECLPLILIIRNRLKYALTYREVISILMQRHVLVDGKVRTDKTYPAGFMDVISIPKTGENYRLLYDTKGRFRLQSVKDEDAKAQFKLCKVRSVQFGQKGIPYLNTYDGRTIRYPDPIIKANDTIKIDLETNKIVDFIKFDVGNVVMVTGGRNTGRVGVIKNREKHKGSFETIHVEDALGHQFATRLGNVFTIGKGNKPWVSLPKGKGIKLSIIEEQRKRDAAAQAAANA

SEQ ID NO: 35 - DNA, 855 bp, Oryza sativa
atggctctccagctgagcggtctcgccgaagtcgtgcgcgagggaggcggctcaggaggatggggcgcacctacaacctgctcaagatggtggaagcggttctcccaggcctcatcgacgacccctaccacgcctccgacttcctccgcgacatggagcataaaatcaggacccgcgctactttctccggtgtctccttccgcgtcctcgccgttcgagttctgcaacctcctgcgcgactacaacgaccgcatcatcgctgatcctcccgtctctacccgcgaggagctccaggaccacatcaacgagctcatcgcccaactcgatgaccttctgcaccagacctgcacgctgcgccaagatgacccggtgggaggtggcatgaatatcaaatctgattgtgacgaaccatccccgcattgttcttgcgtaggacaaacggacatatcttgggttacctatttttggaattctgttgagtttgaactaacatattgccttgctgtgggaggtggcatgaagatcaaagctgattgtgatgagtcatccccatatgcagctatgcttgtttctcaagatgttgcactgtgttgcaagatcttgggtgactgttttctggaattctgtctcattatgctctgtgcggctggaggcaacaagacaaacacacctggacctgatgctcaatctgctctcagggctcttgctcttgctcggtctgggatgaatattggtcgcattgggtccagatcacaacttttgctggtgtgctgtcctgatctggtttcatgtgatttgttgaatgatgatggacctggctacgagcaggcttccctgaaagaccagagaatttga

SEQ ID NO: 36 - protein, 284 aa, Oryza sativa
MALQLSGLAEVVREGGGSGGWGAPTTCSRWWKRFSQASSTTPTTPPTSSATWSIKSGPALLSPVSPSASSPFEFCNLLRDYNDRIIADPPVSTREELQDHINELIAQLDDLLHQTCTLRQDDPVGGGMNIKSDCDEPSPHCSCVGQTDISWVTYFWNSVEFELTYCLAVGGGMKIKADCDESSPYAAMLVSQDVALCCKILGDCFLEFCLIMLCAAGGNKTNTPGPDAQSALRALALARSGMNIGRIGSRSQLLLVCCPDLVSCDLLNDDGPGYEQASLKDQRI

SEQ ID NO: 37 - DNA, 2790 bp, Oryza sativa
atggcggcatggtcgtggttaattctactatgcctcgtcgccgccgccaccgccggcgtgctccaagctcgtgcccagcctgatagcaaagaggtttcattagcgtagactgcggcctcccggggaagacgagctacgtggacgacaagaccaagatatcctacgcggcggacgacggcttcaccgacggcggctcgttccacaacatctcggcggagtacatcacgccggcgctctcggcgcgctaccacaacgtgcgcagcttccccgacggcgcgcgcaactgctacacgctccggtcgctcgtggccggcctcaagtacctcatccgcgccaccttcatgtacggcaactacgacggcctcagcaagctgccaatcttcgacgtctacatcggcgtcaacttctggatgatggtcaacatctcggacccctccggcgcgacgctcctggaggccatcgtcgtcgtgccggacgacttcgtgcaggtttgcctcgtgaacaccggcaccgggacaccgttcatctccgggctggacctcaggcctctcgagaagaagctctacccgcaggcgaacgacaagcggggcctgtccttgttcggcagatggaactttggcccaattagtactaccgagttcatcagaggtaccccgacgatccacacgacagaatatggatgccttgggtctcgccatcatattgggtcgaggtatcgacgacgaggccggtgcagcacacggacgaggacgtattcgacgcgccgacgaaggtgatgcagacggcgattgcgccgctcaacgcctcgagcaacatcgagttcgcctgggtaccctacacgcagcccaaggacccggcgccggggtacatcaccgtcatgcacttctccgagctgcagctccgctccagcaacgccacgcgccagttctacatcaacctcaacggcaacatggtgtttagccagggctacacgccggcgtacctctacgccgacgccatcttcaacagcaacccgttcctacgatacccgcagtacaacatctccatcaacgccaccgccaactcgacgctgccaccgatcatcaacgccatcgaggtgttctccgtcttctccaccgccaccgttggcacagatggtcaggatggcttccgccatgatggtgatcaaggaaaagtatcaggtgaagaagaactggatgggtgatccgtgcgttccaaagacgcttgcgtgggataagttgacatgcagctatgacagctccaaacctgcaagaatcacagacataaatctgtcatccggtggtttaagtggtgagatatcgtccgcttttgcgaatctcaaggctcttcaaaacttgatctgtcaaacaacaatttgacaggttcgattccagatgcactttcacagttgccttcgttggcagtattagatttgacaggaaatcaactcaatggttcaattccatctggacttctcaaaagaattcaagatggtaccctaaatataaaagatacggaaataacccaaacctctgcaccaacgacaattcatgtcagccagcaaaacacaagagcaagcttgccatctatgtagctgttcctgtagttctggttttggtgatagtatcagtcacaatactgctcttttgccttctgggacgaaaaaagaagcaagggatcaatgaacacttccgtaaagccgcagaatgagacagcgagctatgtgccgacaaatggcagccatgggcatggctcatcaatgcagcttgagaaccgacggtttacttacaatgatttagagaagataacaaacaactttcagcgagtgctcggcgaaggagggtttgggaaggtctacgatggcttcttggaagatggcactcaagtggcagtcaaattaaggtctgaatcttccaaccaaggggataaggaatttctcgcagagaggctcagattttaactcggattcaccacaagagccttgtatctatgatcggttattgcaaggatgggaaatacatggcacttgtctatgagtacatgtcagaaggaacccttcgagaacatatttcagatacttaacctggagagagaggcttcgaatcgcgctggaatccgctcaagagagatgtgaaggctaccaacattctattgaatgcgaagctagaggctaagattgctgattttggcttatccaagacgttcaatcttgagaatggcacacatgtatctacgaacacgcttgttggcacacctggatacgtggatccagagtatgttaatccatattaccaggcaacaatgcaaccaacgaccaagagtgacgtctatagctttggtgttgtcctattggagctggtcacagggaagccggctgtcctacgtgatccagagcccataagtatcattcattgggcgcaacagcgcctagcacagggtaatattgagggagtggtggatgcacgtatgcatggtgaccatgatgtaaatggtgtatggaaggctacggacatcgcactcaagtgtaccacacaagtatcggcacaacggcccactatgaccgatgtggtggcacaactgcaagagtgcctcgagctcgaggaggggcgttgtgccatcagcaatgcgaacaacaatttctataccgacaataacagcaactctaactcaagttatgacatgtatgccactgaccactctattgatgtaagtcagaacagcgctgcatttgagacggagcgtaattttggaaggatgccatcaacggccaccggtccagctgcacgataa

SEQ ID NO: 38 - protein, 319 aa, Oryza sativa
  misc_feature (36)..(36): Xaa = any naturally occuring amino acid
  misc_feature (138)..(138): Xaa = any naturally occuring amino acid
  misc_feature (167)..(167): Xaa = any naturally occuring amino acid
MAAWSWLILLCLVAAATAGVLQARAQPDSKEVSLAXTAASRGRRATWTTRPRYPTRRTTASPTAARSTTSRRSTSRRRSRRATTTCAASPTARATATRSGRSWPASSTSSAPPSCTATTTASASCQSSTSTSASTSGXWSTSRTPPARRSWRPSSSCRTTSCRFASXTPAPGHRSSPGWTSGLSRRSSTRRRTTSGACPCSADGTLAQLVLPSSSEVPRRSTRQNMDALGLAIILGRGIDDEAGAAHGRGRIRRADEGDADGDCAAQRLEQHRVRLGTLHAAQGPGAGVHHRHALLRAAAPLQQRHAPVLHQPQRQHGV

SEQ ID NO: 39 - DNA, 303 bp, Oryza sativa
atggcgccgtcgcagccgaagtccgggctcttcgtgggcatcaacaagggccacgtcgtcaccaagcgcgagctgccgcctcgcccgtccgaccgcaaggggtttgtcaggaacttgatcagggaggttgctggatttgctccctatgagaagcgtatcactgagcttctcaaagttggcaaggacaagcgtgcactgaaggtggcaaagagaaagcttggcacccacaagagggccaagaagaagagagaggagatggctggtgtcctcaggaagatgaggtgtgtaatcttccagccttga

SEQ ID NO: 40 - protein, 101 aa, Oryza sativa
  misc_feature (35)..(41): Xaa = any naturally occuring amino acid
MAPSQPKSGLFVGINKGHVVTKRELPPRPSDRKGXXXXXXXFVRNLIREVAGFAPYEKRITELLKVGKDKRALKVAKRKLGHPQEGQEEERGDGWCPQEDE

SEQ ID NO: 41 - DNA, 819 bp, Oryza sativa
atggcggcgatctcgcgcgcgatccgggcgtgcgccgccgcggggtcccggcggagcatggcgtcgtcggcgaaggaggtggcggcggccggggcgcgggcggcggcggcggtggcgcggcgcgggcgggagcgggagcgggaggaggacgggaggcgcgtgcagtgggtgttcctgggctgccccggggtggggaagggcacctacgccagccgcctctcgcagatgctccgcgtgccccacatcgccaccggcgatctcgtccgcgacgccctcgcctccccgggccccttctccgagcagcttgcggagattgtgaataatggaaagctagtgtcggatgagatcataataaatcttctgtcaaagcggcttgaagagggagcagaaaagggtgagctgggcttcatccttgatggttttccaagaaccataagacaagcggagatacttgaaggagtcacggatattgatttggtcatcaacctcaaactccgagaagaggctctgcttgcaaaatgccttggtagaaggatgtgcagccagtgtggtggaaattttaatgtagcgtccattgatatggagggcgaaaatggtggtcctcgaatgtacatgcctccactactgcctcctccacagtgtgaatcaaagttgataactaggcctgatgatactgaagaggtgccagtggaggacttctacagagcacgtggtaaactattggagttcaatctaccaggaggaattccagaatcatggccgaagttactgcaagcattgaatttagaccctggcaatgaaagatctgcagcagcatga

SEQ ID NO: 42 - protein, 273 aa, Oryza sativa
  misc_feature (168)..(168): Xaa = any naturally occuring amino acid
MAAISRAIRACAAAGSRRSMASSAKEVAAAGARAAAAVARRGREREREEDGRRVQWVFLGCPGVGKGTYASRLSQMLRVPHIATGDLVRDALASPGPFSEQLAEIVNNGKLVSDEIIINLLSKRLEEGAEKGELGFILDGFPRTIRQAEILEGVTDIDLVINLKLREXEALLAKCLGRRMCSQCGGNFNVASIDMEGENGGPRMYMPPLLPPPQCESKLITRPDDTEEVPVEDFYRARGKLLEFNLPGGIPESWPKLLQALNLDPGNERSAAA

SEQ ID NO: 43 - DNA, 451 bp, Oryza sativa
atgctctcgatttcctcctgttttgatcgcgtctgtgtggtttggtctggtcaggtggtgctgcaaccagatccgtttctgagcgagttgacgagcatgtacgagcggagcacggagaagggatctgtctgggtcaccatgaagcgatcatcgatgaagtgccaggcaaggttgaagaagatggcggcgaagggagaggcagtggagtaccggtgcctcgtccgtgccaccgatggcaagaagaacatctgcaccgcggctctctgcaaaggagtacctgaagttccaagcttcatatgccacagttcttaaagcccatatgcacgctttgaagaagagggagaggaaagacaagaagaaggctgcagaggttgagaagataccagagaaggcaccgaagaagcagaagaaagcaccgtcttcaaagaaatctgcagggtccaagtcgtaa

SEQ ID NO: 44 - protein, 149 aa, Oryza sativa
MLSISSCFDRVCVVWSGQVVLQPDPFLSELTSMYERSTEKGSVWVTMKRSSMKCQARLKKMAAKGEAVEYRCLVRATDGKKNICTALSAKEYLKFQASYATVLKAHMHALKKRERKDKKKAAEVEKIPEKAPKKQKKAPSSKKSAGSKS

SEQ ID NO: 45 - DNA, 1770 bp, Oryza sativa
  misc_feature (52)..(52): n = any nucleotide
  misc_feature (60)..(60): n = any nucleotide
atgccgaactgctacgattgcattaaattcagagatgcacatgctgaagcancaagcgtngataacaaggatagagagcatcacccccctggatttgcaatggacaagaatgctcttcttcagttgagctttttccctgttccaattcaggcttcgtttcaatatcctccttatcctgaaggacgagaggatgtgctggctgcagcttattcacattccacattgctgggaaatcaactgcaatcactggacgatgacgcaattttagccacgcttgatgcgcggcagtgtcagctgtttgagcagaaaacgcaagactccttccttcagagcaggagtcgtcgctgccatccctgttctggcgccggcaatcccattgtcgccgccgacgcgggcaatcttcttgatcccgacgaaagtctcggtgaaccgacggatgtaaaccacgcggtagttcggcggcaagcggaactcgctcgccgagccaattggggcggcaaagatgccgccatccttgagcaccctgtcgacgaggccaaccctgtcgccgtccttgtcgaagtagccgaaatccagcacgaagtcgacggacaggtcccccgtcgtcagcaactcccgcggcgtgatgcgtcgcatgtcgtcgccgtcgagggcgggagggtggtggtggcagtctccatcggcggcgccgaggaagacggcgcgcgcgccgggggcgagcaggccctcgcggcggaggtcgcggagcaggagccccacctggagcgcgtccccggcgggggcctcggcatcgcggagccaggccagggagagcagcgcgacggcgaggagcaccgagcgcgcgatcacgcggaggacgcgcgggtccgggagccggatcaccacgcagccgggggattagcgggtgcagaagcgggcggcggtgtggttgccacccacgagggcgaggcgggcgtgcggcgcgcggagcgtgaggaggaggaggtgacggatccgctcggtctccatggaggcgacgcgccctgcctcacccgcctcgggccgagatcggctacggaatttgggaggttttcgtgggaagaattgggagggtgcgggtggatggcgatgagcggcggcgcgccgggtgtgtccccgtgtttatgggggcggtaccgcgctaggttgggtggcttcggaacggtccggtgggaagcgagcggtccggtcgggggcacagtgggggactggggatggatgggcgagccgcacggcaccaccaatccaccactgatcatactagcacagagcgccgccgccgaggagagtccaatcgagaagaagggaggagaggcaagcggagaggaagaagaagaagaagagaggatgggcttcgagaagacgatcctgaaagccggcaccggtcccaagcccgtcaagggccagaaggtcaccgtccactgcaccggcttcgggaaagataatgatctcgctaagaagttttggagaaaatttatcgttagacctcacaaatcaaaattcttggagcacaaaggacgcaggccaggagccattcagtttcaatataggccagggttcggtgatcaaaggtataacactactctcttgcttataggatgggacgagggagttatgaccatgcaagtgggtgaagttgctcgtattcagtgcaccccggattatgcgtatggagctagtgggtttccggcctggggaattcgaccaaactcagtgctggtgttcgagattgaggttcttagcgcccagtaa

SEQ ID NO: 46 - protein, 589 aa, Oryza sativa
MPNCYDCIKFRDAHAEAPSVDNKDREHHPPGFAMDKNALLQLSFFPVPIQASFQYPPYPEGREDVLAAAYSHSTLLGNQLQSLDDDAILATLDARQCQLFEQKTQDSFLQSRSRRCHPCSGAGNPIVAADAGNLLDPDESLGEPTDVNHAVVRRQAELARRANWGGKDAAILEHPVDEANPVAVLVEVAEIQHEVDGQVPRRQQLPRRDASHVVAVEGGRVVVAVSIGGAEEDGARAGGEQALAAEVAEQEPHLERVPGGGLGIAEPGQGEQRDGEEHRARDHAEDARVREPDHHAAGGLAGAEAGGGVVATHEGEAGVRRAEREEEEVTDPLGLHGGDAPCLTRLGPRSATEFGRFSWEELGGCGWMAMSGGAPGVSPCLWGRYRARLGGFGTVRWEASGPVGGTVGDWGWMGEPHGTTNPPLIILAQSAAAEESPIEKKGGEASGEEEEEEERMGFEKTILKAGTGPKPVKGQKVTVHCTGFGKDNDLAKKFWRKFIVRPHKSKFLEHKGRRPGAIQFQYRPGFGDQRYNTTLLLIGWDEGVMTMQVGEVARIQCTPDYAYGASGFPAWGIRPNSVLVFEIEVLSAQ

SEQ ID NO: 47 - DNA, 818 bp, Oryza sativa
atggtggaggacgcggacggggagggggcgaggcggtgggagacgttcgtcgtccccggggcgaggaggaacgcgctcttctgccgcgtctgggcgcccgccgccgccgccgccgagatgagcatgggcttaatgagcacagagtggaaggtatttgcactttgcggagctgctcacatcatgtggctttggagtatatgcaatggactggatagggccatggtggaagcgatggtctacatggttatgtgccttcactagattatgttgtagaagatatagagaatccaggggtcccctgttttcttcttggtcactccactggtggagctgttgttttgaaggaaggcatcatcctaacttcaccagctctgcgtgtaaaacctgctcatcccattgtaggggtggcgccaatattctctctgttagcaccaaagtttcagttcaagggagctaacaagagaggcatcccggtgtcccgcgacccggctgccctgctagcgaagtactccgatccgctggtttacaccgggccgatcagagttcggaccggccatgaaatcctacgcatctcctcctacctgctgcacaacttgaagaaggtcaccgtcccattcatggtcctccatggaaccgcagaccgggtgaccgaccccctggcttcacaggacctctacaacgaggcctcatcgaggcacaaggatctgaggctgtacgatgggttcttgcacgatctgctctttgagcctgagcgtgatgagatcgccacagacatcatcgactggatggagcgaatgctagctctgcaaaccgtgtga

SEQ ID NO: 48 - protein, 271 aa, Oryza sativa
GGGRGRGGGEAVGDVRRPRGEEERALLPRLGARRRRRRDEHGLNEHRSGRYLHFAELLTSCGFGVYAMDWIGHGGSDGLHGYVPSLDYVVEDIENPGVPCFLLGHSTGGAVVLKEGIILTSPALRVKPAHPIVGVAPIFSLLAPKFQFKGANKRGIPVSRDPAALLAKYSDPLVYTGPIRVRTGHEILRISSYLLHNLKKVTVPFMVLHGTADRVTDPLASQDLYNEASSRHKDLRLYDGFLHDLLFEPERDEIATDIIDWMERMLALQTV

SEQ ID NO: 49 - DNA, 2045 bp, Oryza sativa
  misc_feature (1466)..(1466): m = adenine or cytosine
atggctgagaagaagggggtgggttcacttcttcccgggctcgccgtcgtcctcgttggcttcgtggtcggcggcgccgggagcgacgaccggttcgtctacgccggcttcaccggcgcgccgctcgcgttggacgggacggcggccatcacggcgagcgggctgctcgagctgaccaacggcacggcgcagctcaaggcgcacgcggtgcacccggcggcgctgcgcttccacggcggcggcggcggcggcggcgcggtgcgctccttctcgacgtcgttcgtgttcgggatcatcccgccttactccgacctgagcggccatggcatcgtcttcttcgtcgggaagaacaacttcaccgccgcgctgccgagccagtacctgggcctcctcaacagcaccaacaacggcaacaccaccaaccacatcttcggcgtcgagctcgacaccatcgtcagctccgagttccaggatcctaacgacaaccacgtcggcatcgacatcaacagcctcaagtccgtcgccgtgaacaccgccggctactacgacgacaagaccggcgccttccacgactgtccctgatcagcggcaaggccatgcagaagcctacgaggccactggtgtctgccgtgtacaacctctcacaggtgctcgtcgatccggtgtacgtcggcttctcgtcggcgacgggcacggtgaggtcacgccactacgttcttggctggagcttcgccatggacgggcctgctcctgccattgacatcgccatgctgcccaagctgccgttctatggcaccaaggcacggtccaaggtattggatatcgttctgcccatagcaaccgcggtgttcgtcctcggtgtggttgtagtggtggttttgcttgtcaggaggagattgaagtatgctgagctgcgagaagactgggaggttgaatttgggccgcaccgattcacatacaaggacttgttccgagcgacggaagggttcaaggccaagatgttgctgggtataggaggatttgggagggtgtacaagggagttctaccgaaatccaatatggaggttgcgataaagaaagtgtcccatgaatcgaggcaaggcataaaggagttcattgcagaggtggtgagtattgggcgtcttcggcatcggaacctcgtgcaattattaggttattgccggcgaaaaggtgaacttattttggtttatgactacatgccaaacggtagtcttgataaatacctatatgatgataagaacaagcctactctggattggactcaaaggttccgcatcataaaaggggtagcatctggcctactgtatattcatgaggattgggagcaagttgtcattcattgagatatcaaagcaagtaacgttcttcttgatagtgagatgaatggacggttaggcgactttggtctagcaagattatatgatcatggtgctgatccacaaacmacacatgtggttggcacaatgggatatctagccccagaattagcacgatcaggaaaggcatcccctctaaccgatgtttttgcatttggtgcctttctcctcgaagttacatgtggacgaagacctgttgagcaagccatgcaagacaaccaactcatgttggtcgattgggtgcttgagcattggcagaaaggatcacttacaaaggtaattgatgcaaggctccatggcaactacaacattgatgaggcaatcctagtgttgaagttagggttgttgtgttcacatccattgcccggtgcaaggcctagcatgcgacaggttgtgcagtatcttgaaggtgacatgcccttccctgagctaacgccaacacatctaagctttagcatgctagctcttatgcaaaatgaaggctttgactcttttgtcatgtcaacatcgcttccatcagagacgatgatgaccattggcacgatgagtggcctctctggaggaagatagtacagtagcacctacttgttagtttttttatcctacgaaaagttttatttccttggtgtaaatgtttgtaatatttag

SEQ ID NO: 50 - protein, 654 aa, Oryza sativa
  misc_feature (454)..(454): Xaa = any naturally occuring amino acid
MAEKKGVGSLLPGLAVVLVGFVVGGAGSDDRFVYAGFTGAPLALDGTAAITASGLLELTNGTAQLKAHAVHPAALRFHGGGGGGGAVRSFSTSFVFGIIPPYSDLSGHGIVFFVGKNNFTAALPSQYLGLLNSTNNGNTTNHIFGVELDTIVSSEFQDPNDNHVGIDINSLKSVAVNTAGYYDDKTGAFHLSLISGKAMQKPTRPLVSAVYNLSQVLVDPVYVGFSSATGTVRSRHYVLGWSFAMDGPAPAIDIAMLPKLPFYGTKARSKVLDIVLPIATAVFVLGVVVVVVLLVRRRLKYAELREDWEVEFGPHRFTYKDLFRATEGFKAKMLLGIGGFGRVYKGVLPKSNMEVAIKKVSHESRQGIKEFIAEVVSIGRLRHRNLVQLLGYCRRKGELILVYDYMPNGSLDKYLYDDKNKPTLDWTQRFRIIKGVASGLLYIHEDWEQVVIHXDIKASNVLLDSEMNGRLGDFGLARLYDHGADPQTTHVVGTMGYLAPELARSGKASPLTDVFAFGAFLLEVTCGRRPVEQAMQDNQLMLVDWVLEHWQKGSLTKVIDARLHGNYNIDEAILVLKLGLLCSHPLPGARPSMRQVVQYLEGDMPFPELTPTHLSFSMLALMQNEGFDSFVMSTSLPSETMMTIGTMSGLSGGR

SEQ ID NO: 51 - DNA, 480 bp, Oryza sativa
atgttatttgtgtgtattgctacatttgtacagaccgattgggaaggtgggtactaccctcttacccttcacttcagtgaggactatcctagcaaaccacccaagtgcaagttcccacagggctttttccacccaaatgtctatccttcaggaacagtgtgcctctcaattcttaatgaggatagtggctggagacctgctatcactgtaaagcagatccttgttggaatacaggacttgcttgatcagccaaatcctgctgatcctgcacagactgacggttatcacatttttatacagcaggacaaaccagaatataagaggcgtgttcgtgttcaggccaagcagtaccctgctttgctttgaggacattggcctaataaagttactacccgattcatcatgcacatccgcatagtagtttgcaaaatctcagattattgcaccagaaaatatcggattttatgggatataacctaa

SEQ ID NO: 52 - protein, 121 aa, Oryza sativa
MLFVCIATFVQTDWEGGYYPLTLHFSEDYPSKPPKCKFPQGFFHPNVYPSGTVCLSILNEDSGWRPAITVKQILVGIQDLLDQPNPADPAQTDGYHIFIQQDKPEYKRRVRVQAKQYPALL

SEQ ID NO: 53 - DNA, 483 bp, Oryza sativa
atgagcgccacggcggtgtcgtcgctgaacccggacgcgccgctcttcatcccggcggcgttccggcaggtggaggacttctcgccgcagtggtgggacctcgtcaagaccaccgcctggttccgcgaccactggttccacgagcaccagcagctcgacgagatggccgactccctcgccctccacgacgccgccgccgacgacgacgacctcgccggcctcctccccgacgacgccttcgacgacgacgacgacgacgacctcttcttcgaccagacccataacctcctcgtcgatcccccgcagccgcccgccgctctcaagactgatgcggtgctcaaggcgctgagcctggtgtctcccaagggcggcgacgcgccgcgggggctccgggagaagccccggcactccgagaagcccaccaagtacgccggcagcccgaggagcggcggcgctccccgcgtcatccaccagcctcgctag

SEQ ID NO: 54 - protein, 160 aa, Oryza sativa
MSATAVSSLNPDAPLFIPAAFRQVEDFSPQWWDLVKTTAWFRDHWFHEHQQLDEMADSLALHDAAADDDDLAGLLPDDAFDDDDDDDLFFDQTHNLLVDPPQPPAALKTDAVLKALSLVSPKGGDAPRGLREKPRHSEKPTKYAGSPRSGGAPRVIHQPR

SEQ ID NO: 55 - DNA, 912 bp, Oryza sativa
atggcccagccagcgtggatccccttcccctccaccgttacataccggcggcacgaagcggagtggatagcagccggtttccggcccaacgcctccggtgtgtccgatgctgatcgtttctgggactcagagcgcccctcctgccgcctcatcatctaccgtagttgtcccgaggcagagccgcgactgttcccgctcctcaccaagctctatactaagccggccatcccctccggcctccttgtgcctcccgctcttgacgacaatgatattggtgtgtacaatagatccgaccggtccttcgtggcagtgatgcaatggcttgacaagcagccaaacaaatctgtcatctatgtttcactcgggaccgaggcacctatcacagcagaccatatgcatgagctcgcatttggactagagcttgctggtgtgcgcttcctatgggcactccgtcgtccgagtggcatcaactgccacgacgacatgctcctccccagtgggttcgagacacgtgttgctgcacgtggcttagtgtgcacggagtgggtaccgcaggtgcgcatgttagcgcatggtgcagtaggtgtattcttaacacattgcggctggggctccaccgtggagagcttccactatggtcagccactggtgatgctcccttttatcgctgaccagggcctaattgctcaggcggtggcggcaacgggggtaggtgtggaggtggcgaggaactacgacgatggctcgttctacagggatgatgttgcggcggcgatacaaagggtcatggtggaggaggaggggaaggaattggcacacaaagccatagagttgtgcggcatcctcggggatagagtccagcaggagatgtacctttatgagcttatcggctacttacagtgctacaaatga

SEQ ID NO: 56 - protein, 303 aa, Oryza sativa
MAQPAWIPFPSTVTYRRHEAEWIAAGFRPNASGVSDADRFWDSERPSCRLIIYRSCPEAEPRLFPLLTKLYTKPAIPSGLLVPPALDDNDIGVYNRSDRSFVAVMQWLDKQPNKSVIYVSLGTEAPITADHMHELAFGLELAGVRFLWALRRPSGINCHDDMLLPSGFETRVAARGLVCTEWVPQVRMLAHGAVGVFLTHCGWGSTVESFHYGQPLVMLPFIADQGLIAQAVAATGVGVEVARNYDDGSFYRDDVAAAIQRVMVEEEGKELAHKAIELCGILGDRVQQEMYLYELIGYLQCYK

SEQ ID NO: 57 - DNA, 683 bp, Oryza sativa
  misc_feature (142)..(142): y = cytosine or thymine
atgcgcccggtttttgctgcgaggtgcaggggcgtacaagtacgtgtcggagctatggaggaggaagcagtcggacgtgatgaggttcgtgcagcgcgtgcgctgctgggagtaccgccagcagccggccatcgtccgcctyacccgccccacccgccccgacaaggcccgccgcctcggctacaaggccaagcagcagggctatgtggtttaccgtgttcgcgtcaggcgtggtggcaggaagaggccagtgcccaagggtattgtctatggcaagcccaagcaccagggtattacccagctcaagttccagaggaacaagaggtcagttgctgaggagagagctggacgcaagctgggtggactcagggtgctcaactcctactgggtgaatgaggactccacctacaagtactttgagatcatccttgtggatgttgctcacagcgctatccgcaatgacccaaggatcaactggctctgcaagcctgtgcacaagcaccgtgagctccgtggcctcacctctgctggcaagaagtaccgtggcccttcccgcagggccacctggaagcgcaaccagaccgtctctcttcgtcgctaccgttaagcttatgtgctttggtgtttcgttacagtggaatctgtcccttgcagacattaattatctgtctattttcttgtga

SEQ ID NO: 58 - protein, 201 aa, Oryza sativa
CARFLLRGAGAYKYVSELWRRKQSDVMRFVQRVRCWEYRQQPAIVRLTRPTRPDKARRLGYKAKQQGYVVYRVRVRRGGRKRPVPKGIVYGKPKHQGITQLKFQRNKRSVAEERAGRKLGGLRVLNSYWVNEDSTYKYFEIILVDVAHSAIRNDPRINWLCKPVHKHRELRGLTSAGKKYRGPSRRATWKRNQTVSLRRYR

SEQ ID NO: 59 - DNA, 936 bp, Oryza sativa
  misc_feature (686)..(686): w = adenine or thymine
  misc_feature (695)..(695): y = cytosine or thymine
atgggcagcatcggcggcgacgaggcggcggtgctgcgggcggaggagtcggcgtcggggggcgtcgacgtgtggagcgacgccgtctcctcccacgaccccgaccacctcctcgtcatggtccacggcatcctcggctttgtaaagcaacttcctgatgatgtaatcgtgcactagtgagaaaaacattaataccttgactctagaaggtgtagatgttatgggggaacgtttagcagatgagatcattcgaaagccagaactcactaagatttcctttcttgcacactctgttggaggattagcagcaagatatgcaattgcaaagctttatagacatccaagtgacacatccaagagtgaaacgaaaggaaccatcggcgggttggaagcaatgaactttataaccgtagcaacacctcaccttgggtctcgagggaacaatcaggttccccttctctttgggtccattgcaatggaaaattttgcttctcgtgtggtccattggatatttaggagaactgggaaacatctttttctcactgatgatgatgagggagaaccaccattattgcagcgcatggctgaagattatggtgatctttatttcatttcagatctgctttgcatgcatttagacgacgagtggcttatgcaaatgccgactgcgatcgtatccttgttawttgaaataycttggtttttgatgaaaagtacccccacattgtacatgaggaaggacttcgacgagtatcatgggaaaaagtagatgttagcttccataccagcatgcagagatttgctgcacacagcataatccagtcctctaacaaaaggtttaaaatcttaatttgctgtttgctccaggtcaagtaccagtttatgaacgaaggcgcggatgtcatacagcacataatagaccacttccaagtctga

SEQ ID NO: 60 - protein, 311 aa, Oryza sativa
  misc_feature (229)..(229): Xaa = any naturally occuring amino acid
  misc_feature (232)..(232): Xaa = any naturally occuring amino acid
MGSIGGDEAAVLRAEESASGGVDVWSDAVSSHDPDHLLVMVHGILGFVKQLPDDVIVHXEKNINTLTLEGVDVMGERLADEIIRKPELTKISFLAHSVGGLAARYAIAKLYRHPSDTSKSETKGTIGGLEAMNFITVATPHLGSRGNNQVPLLFGSIAMENFASRVVHWIFRRTGKHLFLTDDDEGEPPLLQRMAEDYGDLYFIFRSALHAFRRRVAYANADCDRILVXKNXLVFDEKYPHIVHEEGLRRVSWEKVDVSFHTSMQRFAAHSIIQSSNKRFKILICCLLQVKYQFMNEGADVIQHIIDHFQV

SEQ ID NO: 61 - DNA, 1190 bp, Oryza sativa
atgtgttacacaaaaaggttccagaattattacgacaagacattttagataaccatagattgccctctagatatcaaaaccacattaagcaacagccgcagaatgttccaatggtagccagcacctcccaaggcaaatcagtacttgtagtccttgacgtgaaggctctcggaggcgccctcgccgaggacagcgtcacccttggccttctcaatgttctccgccttgccggaccaggccttgagcgtgctctgctggagggcacggccgaaggagaaggacagcgaccacggcttcttggtgctgagcttgttcatggcgttgaggttcagggtcgcctcctcctcgctctgcccaccggacaggaagacgatggcgggcacggcagcggggacggtcctctggagggtgcggacggtgtactcagcgatgacctcgggagacaccttcttggcgtcagagcctggggtgaccatgttgggcttgaggagggtaccctcgaggaggacatggtgctcgttgagggccttgtagcacgcagcgaggaccacctccgagacgtaggcgcagcggtcgatgtcgtgagggccatcaacaaggatctcgggctcgacgatcggcaccagcccgttctcctggcagatgatggcgtagcgagcgaggccctgcgcattcagatcaatggcgagctgcgacggctcgttggggccgatcttgaggacggcgcgccacttggcgaagcgggcaccagcctcgtagtacttggcgcatctcttgccaaggtcatcatggccctgggtggtggtctccttctcggtgccggcaacctcgattgtgcccttgtccaccttgatgcccgggaggacaccaccctccttgaggacatcgacgaagggcttgccatccttggtcttctggtacagggtctcctcgaagaggatcacgccgctgaggtactggagggcgccaggggtgcagaagaggagctcgcggagggagcggcggttctcctcaacgttctcgacgttgatgctggcgaagcgcttgccaatggtgccagtggactcatccgcagcaaggatacccttgccaggagtgccaatgtaggcagcgttcttgatgagctcgtctgcaagatggcaaacactatattattaacaaaaaaaaagcagcatctctgtatggcctaa

SEQ ID NO: 62 - protein, 395 aa, Oryza sativa
  misc_feature (16)..(16): Xaa = any naturally occuring amino acid
  misc_feature (39)..(39): Xaa = any naturally occuring amino acid
  misc_feature (52)..(52): Xaa = any naturally occuring amino acid
MCYTKRFQNYYDKTFXITIDCPLDIKTTLSNSRRMFQWXPAPPRQISTCSPXREGSRRRPRRGQRHPWPSNVLRLAGPGLERALLEGTAEGEGQRPRLLGAELVHGVEVQGRLLLALPTGQEDDGGHGSGDGPLEGADGVLSDDLGRHLLGVRAWGDHVGLEEGTLEEDMVLVEGLVARSEDHLRDVGAAVDVVRAINKDLGLDDRHQPVLLADDGVASEALRIQINGELRRLVGADLEDGAPLGEAGTSLVVLGASLAKVIMALGGGLLLGAGNLDCALVHLDAREDTTLLEDIDEGLAILGLLVQGLLEEDHAAEVLEGARGAEEELAEGAAVLLNVLDVDAGEALANGASGLIRSKDTLARSANVGSVLDELVCKMANTILLTKKKQHLCMA

SEQ ID NO: 63 - DNA, 1806 bp, Oryza sativa
atggcgtccctccgcgcgctcagcgctcccctgcttctgttgttgctacggcttcctctgtcgcctccccgcccgcgccaccatctcgggcagctccacagcgcggatgtcatgtcagtaaaacagggcaaaaatactgccgagggacctcggatgaacggtttgacccaaaaccgcgtgtttaccgcctgtggttatcatcagccaccacgccgccatctcccatggcgacgacgtggaccaacgcctaaaccccacaattttgttcccccaaaaattctaaacctccgcgtcgccttcttcttcttcttcctccgcaagcttgctagcctcctcctcctccgcgccatgatggggagcagggtggcggcggcgctgctccgccgggggagggaccaggcgtcctcgctcatggccgctcgcctcccgaggggagcccccgctccgtctccggctgctcctagggttggatccggctccgtctgcggctgcggcggcggcggcggtttactaactggatcgaggtcgacgggatccgtcttctccgcatcgcgcctcgcctcgttccacgccttccgttcaatcggctccaagaccttgatgggccaatgcacaaggaaaatgactactactgtggcagcaatgaattcaggcgtggccaatgcagcggcatattcaggattgaagttgcttgttaccaaagggccccaagcacagaaggccatcgggatatggctcttcggatgtgccacgtgggtattcggcttggtcatacttggaggagttacacggcttacacgctcaggattgtcgatgactgactggaaatttacggggagcttgcctccaatgtcagatgaagagtggctgctggaatttgagaaatacaaactgtcacctgagtacaagagggtgaacaaaggcatgagccttggagatttcaaatttatatactggatggagtatggacacagaatgtggggaagggctctgggatttctattttctgttccttttgcctatttcattgcaaaagggtatgttacccgccaacttggactcaggctgtcaggtcttttcgcacttggtgcgggtcaaggactaattggctggtggatggtgaaaagtggtcttgaggaaccagcatctgagtatgttcaaccaagagtcagcccatacagactggcgacccatttaacgtctgcatttgttatatattgtggcatattgtggacagctctgtcagtggttatgccagaacctccggctggatcaatgaattgggtaaattctgcagcaaagattaaaaagttagcaattcctgtcagtgccgtggtaggcattactgccatatctggagcatttgttgcgggcaatgatgcagggcatgcatacaatacatttcccaagatgggtgacacctggataccagaagatgtgttcgctatggagcctttcatacgtaacttctttgagaacacgtccactgtgcagcttaatcaccgaattcttgcaacaactaccctattgtctgtgggtggcttatggttggctgcaaggaaagtggacatgcatccagcaatcaagtctcttatcggaagcacgcttggaatggctgcccttcaggttacattgggaatatctacacttttgatctcatcaagctggggcattgacactactgtcactgatgatccttctcacccacactttaagaagaccgtcaccagcccttctgaagtcacttgcatcagcagtgaaatcaacctgacaccgtgtcatgaaattttccttcaggcacagtag

SEQ ID NO: 64 - protein, 601 aa, Oryza sativa
MASLRALSAPLLLLLLRLPLSPPRPRHHLGQLHSADVMSVKQGKNTAEGPRMNGLTQNRVFTACGYHQPPRRHLPWRRRGPTPKPHNFVPPKILNLRVAFFFFFLRKLASLLLLRAMMGSRVAAALLRRGRDQASSLMAARLPRGAPAPSPAAPRVGSGSVCGCGGGGGLLTGSRSTGSVFSASRLASFHAFRSIGSKTLMGQCTRKMTTTVAAMNSGVANAAAYSGLKLLVTKGPQAQKAIGIWLFGCATWVFGLVILGGVTRLTRSGLSMTDWKFTGSLPPMSDEEWLLEFEKYKLSPEYKRVNKGMSLGDFKFIYWMEYGHRMWGRALGFLFSVPFAYFIAKGYVTRQLGLRLSGLFALGAGQGLIGWWMVKSGLEEPASEYVQPRVSPYRLATHLTSAFVIYCGILWTALSVVMPEPPAGSMNWVNSAAKIKKLAIPVSAVVGITAISGAFVAGNDAGHAYNTFPKMGDTWIPEDVFAMEPFIRNFFENTSTVQLNHRILATTTLLSVGGLWLAARKVDMHPAIKSLIGSTLGMAALQVTLGISTLLISSSWGIDTTVTDDPSHPHFKKTVTSPSEVTCISSEINLTPCHEIFLQAQ

SEQ ID NO: 65 - DNA, 1695 bp, Oryza sativa
  misc_feature (94)..(94): r = adenine or guanine
  misc_feature (97)..(97): r = adenine or guanine
  misc_feature (100)..(100): r = adenine or guanine
  misc_feature (976)..(976): k = guanine or thymine
  misc_feature (1097)..(1097): s = guanine or cytosine
  misc_feature (1612)..(1612): r = adenine or guanine
atggagggctcagcgagggttggtagtaggatgggggcgatggaggcgctgccgctgcctccgccgccgcgcctcgcggcgcgaggcggcgatrgcrgcrgcggcggcggcgggaagttcgggtgccgggtgcggctgccgcggcggtacagctccacctccgccgccggcgccggcgccgaggcgaaggacaccgcctccgagcaggacgccccggccagggtcaaggtcgtcgggagggcgccggatctgtcgctcgacacgccgcggagttcttgcacgctcgacgaggggagaaatgggaagaagaagcaggaggaggagatcatgtcgatgaaccttgggctgggcgcgagcttggtgttgctcttgtccaagggcgccgtggagctgaacaagatggtggagctccgcgcgcagatggaggcgctcgtgtcggagatcaggaaggagacgcagagcaagcacaaggactccgccgccgccgccaccgccgccgcccgttcgagctcgcaagaatccgatggtcgcagcaccaccgccgtgaaggatcccatcgcccgcgccgccgtctccgacgacgcgatgtccaactgctccggcggcggcggcggcagcggaggacgcgccgccgtggtgatgcaccggatggaggcggagctccaggtggagctgagccgcttgcagtgcggcagcgtcgccgccgcgcacggcgagaagcgtggcgctcctcccaccatgcacggactcgaggtgaagacgacgacgaagagcaacgtgtcggacagcccgccgaggagctgcgtcgtcgacgacgacgacgacgtggcagaaggtggcaatggcggagaggtggtcgaggaagacgacgacgacgacgaggaggacgaagagtatgacgaggagggggaggaggaagaagaggaggagtacggcggcggcggcggcggggacaagagcccgccgcacggcggcktgtcggcgcgggcgctggagcggcggctgtacgagctgctgcagaagcggcagcaggagcggatcgtggagctggaggccgccctggacgccacccagcgccgcctccacgagaaggagcscgaggtcgtgtggtggcgcgaagccgccaagctcgtcacccaccgcccgcgacgagtcccgccgctttcgccagatcgctgcagtttgcagacgccatcagtacactgcggctgcattaaccccagcaggctagcgatcgaaagggcaaactggcgctgtgaaaaaactgaaaattcagaaggctgcagtgaacagtggcagcatggcacagtgccaggctctagattttcgaggtacaggctgggacatggtggccgaaaattgatgggcagtgaggacacaaaagatatgctgaagaatgtggactggaaaacagttggtggtggttcagtgactactgacccaagccaaccagttgttaaaaagcgtctcccaaagaaaattagacaagttcctgaatgctattttctgcctcggcgatatttgccttctgcattggcaatctatggcgctgtgtgtgctgctggagttggcgcagggatgctgcttgagaggacagtgccattgtctgggraatgggcaaatgatttgattgctacctctgaagagttctccttgctcttgtgttcagctgctaaagctgcatctcagaaataa

SEQ ID NO: 66 - protein, 564 aa, Oryza sativa
MEGSARVGSRMGAMEALPLPPPPRLAARGGDGGGGGGGKFGCRVRLPRRYSSTSAAGAGAEAKDTASEQDAPARVKVVGRAPDLSLDTPRSSCTLDEGRNGKKKQEEEIMSMNLGLGASLVLLLSKGAVELNKMVELRAQMEALVSEIRKETQSKHKDSAAAATAAARSSSQESDGRSTTAVKDPIARAAVSDDAMSNCSGGGGGSGGRAAVVMHRMEAELQVELSRLQCGSVAAAHGEKRGAPPTMHGLEVKTTTKSNVSDSPPRSCVVDDDDDVAEGGNGGEVVEEDDDDDEEDEEYDEEGEEEEEEEYGGGGGGDKSPPHGGLSARALERRLYELLQKRQQERIVELEAALDATQRRLHEKEREVVWWREAAKLVTHRPRRVPPLSPDRCSLQTPSVHCGCINPSRLAIERANWRCEKTENSEGCSEQWQHGTVPGSRFSRYRLGHGGRKLMGSEDTKDMLKNVDWKTVGGGSVTTDPSQPVVKKRLPKKIRQVPECYFLPRRYLPSALAIYGAVCAAGVGAGMLLERTVPLSGEWANDLIATSEEFSLLLCSAAKAASQK

SEQ ID NO: 67 - DNA, 729 bp, Oryza sativa
  misc_feature (252)..(252): s = guanine or cytosine
atgcacacgccgccgcagcttcaccggaagcttcgcctcgaccaccaccaccaccaccaccggcctcagctcccccgccgccgccgccttcacatgccgcgcgatggcgacatgcgcgcgcgttgctgggccgagctgtaccacgacgcgtcggctgctcacggcggcgtggtggcgaacggtgcggcggcggcggcgacgagcccggcgtcgccggcgggatcgacaggcgggagcccgacgcgggcgccsggggttgaggggccgcgcttggggaagccggcgaggaggcggtccagggcgtcgcggcgcgcgcccgtgacgctgctcaacacggacaccaccaacttccgcgccatggtgcagcagttcaccggcatcccggcgccgcccgcgggcgcgttcgcggggcccggcggcgttccggtcatcaacttcggctccgactacggcttcaccggcgccgtccttcccttctccgaccacctccaaccgcgccggccgacgttccaggaccaccaacagctcctccgaccgcagcagcagtacaccggcgcaccgttcggttacggcaacctgcagcaagccggcggcgccggcaccggcgccggcgacatgttcagccacgcgctgagctcggccgaggacaggttgctcctgcagagcctccagtcagctcagatgcctacttccgccgctaaccacagcgctaatggttacttcgcctaa

SEQ ID NO: 68 - protein, 241 aa, Oryza sativa
MHTPPQLHRKLRLDHHHHHHRPQLPRRRRLHMPRDGDMRARCWAELYHDASAAHGGVVANGAAAAATSPASPAGSTGGSPTRAGVEGPRLGKPARRRSRASRRAPVTLLNTDTTNFRAMVQQFTGIPAPPAGAFAGPGGVPVINFGSDYGFTGAVLPFSDHLQPRRPTFQDHQQLLRPQQQYTGAPFGYGNLQQAGGAGTGAGDMFSHALSSAEDRLLLQSLQSAQMPTSAANHSANGYFA

SEQ ID NO: 69 - DNA, 264 bp, Oryza sativa
atgccccaagaactaataacggtgcaccgaggagggagatcaaccaccgtcttctccgactccaacctagcgcccccgtcgtcgattcccgtccaaccgatcaagccatcactgtgtcgccgtcgccgcctgtctactccactgccacccgcgctgcccaacctcaccggagctcgcccatccttggccgactcttgggttaaacctatcggtttagccgatttgatcgatgcccaccgaaatgctgaaattccgaaattttga

SEQ ID NO: 70 - protein, 87 aa, Oryza sativa
MPQELITVHRGGRSTTVFSDSNLAPPSSIPVQPIKPSLCRRRRLSTPLPPALPNLTGARPSLADSWVKPIGLADLIDAHRNAEIPKF

SEQ ID NO: 71 - DNA, 894 bp, Oryza sativa
atggcgccgcgcaactcgctgctcccgagcttcctctacatcgagctgttctcgccggcatactactccgcctgcgccttcggcggggccgccgcgtgcgggctcacccacgccgccgtgaccccgctcgacgtcatcaaatgcaacatacagcagatcgacccgaccaagtacaagagcacgacgtcggcgttcggcgtcgtgatgcgggagcagggcgcgcgcggcttctacagggggtgggcgccgacgttcctcggctacagcgcgcagggggcgttcaagtacggcctgtacgaggtgttcaagaaggagtacgccgacatggccgggccggagtacgccgccaggtacaagaccctcatctacctcgccggctcggccaccgccgaggtggccgccgacgtcgcgctctgccccatggaggccgtcaaggtccgcgtgcagacgcagcccggctacgccagggggctcagcgacggcttcccaaagatcgtcaggaacgaaagctatgcaggggcttggttccgctttgggggcgtcagattccttactatgatgaaatttgcgacgtacgagaacatcgtggagatggcatacaagcatctcatccccacaccgaaggagcaatgcagcaagcctctgcagcttggagtcagcttcgggagtggctacattgctggagtcttctgcgccgccgtctcgcaccctgctgacaacttggtctcgtttctcaacaactccaagggcgccaccgttggagatgctgtcaagaaccttggcctctggggccttttcacccgcggccttcctcttcgcatcctcatgatcggtacactgactggaactcagtgggtgatctatgattctttcaaagttatggttggcctgtaa

SEQ ID NO: 72 - protein, 301 aa, Oryza sativa
  misc_feature (154)..(154): Xaa = any naturally occuring amino acid
  misc_feature (170)..(173): Xaa = any naturally occuring amino acid
MAPRNSLLPSFLYIELFSPAYYSACAFGGAAACGLTHAAVTPLDVIKCNIQQIDPTKYKSTTSAFGVVMREQGARGFYRGWAPTFLGYSAQGAFKYGLYEVFKKEYADMAGPEYAARYKTLIYLAGSATAEVAADVALCPMEAVKVRVQTQPGXRQGAQRRLPKDRQERXXXXKLCRGLVPLWGRQIPYMMKFATYENIVEMAYKHLIPTPKEQCSKPLQLGVSFGSGYIAGVFCAAVSHPADNLVSFLNNSKGATVGDAVKNLGLWGLFTRGLPLRILMIGTLTGTQWVIYDSFKVMVGL

SEQ ID NO: 73 - DNA, 2916 bp, Oryza sativa
atgcccaacaacgcagccatcggaagcatcgtcgccgccgtcggcgtcgtcgccgtggtctgcgcgatcgccgcggtcacgagctccaagaaggatcgcaatggcgagctcaccgccaacgtcaggctctccaccgtgtgctccgtgacgcggtaccctggcaggtgcgagcagagcctcggccccgtcgtgaacgacaccatcgaccccgagagcgtcctccgcgccgcgctgcaggtggcgctcgaagaggtcaccagcgcgttcaaccgctccatggacgtcggcaaggacgacgacgccaagatcaccaagagcgccatcgagatgtgcaagaagctcctcgacgacgccatcgaagatctcaggggcatggcgagcctcaaacccgaggaggtcacgaagcacgtcaacgacctccggtgttggctgtccagcgtcatgacgtacatctacacctgcgccgacggcttcgacaagccggagctgaaggaggccatggacaagctcctgcagaactccaccgagctgagcagcaacgcgctcgccatcatcaccagcctcggcgaactcatgccggctgccaagtcgaacggatccaccggcgcgcaccgccggcttctcgggttgcagggcagtgaggcggcagagggggtaagcttgcgcgagcttcttgccgtccacgacaaggtacaggagctcacagatgtgaaagacgtcagccgccatctcttgtccgagacgctggacgcgatcaccgagatgtcccacgacgcaggccgccgccttcttggcgtcacgctcagcgaagccacagacgacagcgacgacagtggcctccccggccgccggctgctgagtatgtctttccacgacgccgaccacggggtgcacggcggcgatcatcggcggctgagtatgtctttccacgatgctgaccacgaggtgcacggcggcgagcatcggcgtttgagtatgtctttgaacgacgccgaccccgaggagcaaggcggcgagcatcggcgtctgagtatgtctttaaacgacgccgaccccgaggtgcaaggcggcgagcatcggcggctgagtatatctttgaacgacgccgaccccgaggtgcacggcgacgagcatcggcggctgagtatgtctttgaacgacgccgacaccgaggtgcacggcggcgagcatcggcagctgagcatgtctttgaacgacgccgacaccgaggtgcacggcggcgagcatcggcggctgagtatgtctttgaacgaggccggcaccgaacagcccagcggcgagcatcggcagctgagtgtgtcttccagtgacgctggctcctccacggactccacctccgactccgatacgcccggcggcgaccccaaggagcccgcggccgttgatgactccaaaaacgccgtccccggggagcccgccgccgccgccgccgccgagcatcggcagctgggcacgcttttcaacgctatccacaacatgacgagcaaggccgacaccgtcaagcgccggctgctgagcatgccacaagacggctccgacgccaccgagcacgagggcggcgggcgcgcgcttctgtccatccagctccagagcatcgccgacatgtccgccgagatgaaccgccacctcctcgcggcggagctccccgacgagctcgccggcaagcggcagctcctgtccacgacgctcagggagctcaacgaagcaaccacggcggcgaagggccagctcgacaagatcgagaacggcacggtgcactccgacgccatcccggagcgaattctcggagatgagtacagggccaccccccaccaccggctgctcaccacggacgtcgtcggcacgatcgaagacatcgaacacgagcgccacaaccagcccaagcccggcgagttcccgtcgtgggtgtccgcccaccagcggcgtctcctgcaggccggcacgcagaagcccgacaaggtggtcgccaaggacgggagcggcgacttcaagacgatcaccgaggccgtcaacgccgtgcccaagaactccccgacccgcttcgtcatctacgtgaaggccggcgagtacaacgagtacgtcaccatccccagctcgttgcccaacatcttcatgtacggcgacggcccgaccaagacgcgcgtcctcggcaacaagagcaacaaggacggcgtcgccaccatggccacccgcaccttctcggcggaggggaatggattcgtgtgcaagtcgatggggttcgtgaacacggcggggccggaggggcaccaggcggtggcgctgcacgtgcagggggacatgtcggtgttcttcaactgcaagttcgaggggtaccaggacacgctgtacgtgcacgccaacaggcagttcttccggaactgcgaggtgacggggaccatcgactacatcttcggcaactcggcggcggtgttccagagctgcctcatgacggtgcggaagccgatggacaaccaggcgaacatggtgacggcgcacgggcgcaccgaccccaacatgcccaccggcatcgtgctccaggattgccgcatcgtgccggagcaggcgctcttccccgtccgcctccagatcgccagctacctcggccggccatggaaggagtacgcgaggacggtggtgatggagagcgtcatcggcgacttcatcaagccggaggggtggtcggagtggatgggcgacgtggggctcaagacgctctactacgccgagtacgccaacaccgggccaggcgccggcacaagcaagagggtgacgtggccgggataccgcgtcatcggccaggccgaggccacgcagttcaccgccggcgtcttcatcgacggcttgacgtggctcaagaacaccgccacgcccaacgtcatgggcttcgtcaaatga

SEQ ID NO: 74 - protein, 971 aa, Oryza sativa
MPNNAAIGSIVAAVGVVAVVCAIAAVTSSKKDRNGELTANVRLSTVCSVTRYPGRCEQSLGPVVNDTIDPESVLRAALQVALEEVTSAFNRSMDVGKDDDAKITKSAIEMCKKLLDDAIEDLRGMASLKPEEVTKHVNDLRCWLSSVMTYIYTCADGFDKPELKEAMDKLLQNSTELSSNALAIITSLGELMPAAKSNGSTGAHRRLLGLQGSEAAEGVSLRELLAVHDKVQELTDVKDVSRHLLSETLDAITEMSHDAGRRLLGVTLSEATDDSDDSGLPGRRLLSMSFHDADHGVHGGDHRRLSMSFHDADHEVHGGEHRRLSMSLNDADPEEQGGEHRRLSMSLNDADPEVQGGEHRRLSISLNDADPEVHGDEHRRLSMSLNDADTEVHGGEHRQLSMSLNDADTEVHGGEHRRLSMSLNEAGTEQPSGEHRQLSVSSSDAGSSTDSTSDSDTPGGDPKEPAAVDDSKNAVPGEPAAAAAAEHRQLGTLFNAIHNMTSKADTVKRRLLSMPQDGSDATEHEGGGRALLSIQLQSIADMSAEMNRHLLAAELPDELAGKRQLLSTTLRELNEATTAAKGQLDKIENGTVHSDAIPERILGDEYRATPHHRLLTTDVVGTIEDIEHERHNQPKPGEFPSWVSAHQRRLLQAGTQKPDKVVAKDGSGDFKTITEAVNAVPKNSPTRFVIYVKAGEYNEYVTIPSSLPNIFMYGDGPTKTRVLGNKSNKDGVATMATRTFSAEGNGFVCKSMGFVNTAGPEGHQAVALHVQGDMSVFFNCKFEGYQDTLYVHANRQFFRNCEVTGTIDYIFGNSAAVFQSCLMTVRKPMDNQANMVTAHGRTDPNMPTGIVLQDCRIVPEQALFPVRLQIASYLGRPWKEYARTVVMESVIGDFIKPEGWSEWMGDVGLKTLYYAEYANTGPGAGTSKRVTWPGYRVIGQAEATQFTAGVFIDGLTWLKNTATPNVMGFVK

SEQ ID NO: 75 - DNA, 1751 bp, Oryza sativa
  misc_feature (110)..(110): k = guanine or thymine
atgttcgtagtacgtgacaagcacgcgcaccaaccgaagcaggtacctgtgtcgctgcctgtgggccccacacaccccaagacggccattaataaacaaacacgacgtgkacgaagagaagggaggccggcaagaagcatactagcacgctacgaaaccccccttctcttcgtccccaaattgcactacaaaaaaggccgcccctttcttctctcctcgtccttatcaccaccaatccgatcctcttctcttctcttctcttcttccccacatccagttcgattctcatctctcccacaacaaatcacgccatggatccctacaagcggccgtccagcgggagcaattccaccttctggaccaccaactccggcgcccccgtctggaacaacaactccgccctcaccgtcggagagcgagggccctatcctccttgaggactatcatctgattgaaaagcttgcacagtttgacagggagcgtatccctgaacgtgtcgttcatgcaaggggagccagtgccaagggattttttgaggttactcatgatatttctcacctcacatgtgctgattttctccgtgctcctggtgttcagaccccagttattgttcggttctccacagtcgtgcatgagcgtggaagccctgagacattgagggatccacgtggttttgctgtcaagttttacactagagagggtaattttgatcttgttgggaacaatatgcctgtcttttttatccgagatgggatgaaattccctgacatggtccatgctttcaagccaagtccaaagaccaatatgcaggagaactggagaatagttgatttcttttcacaccacccagagagcctgcacatgttctccttcctctttgacgatgtaggcatcccactcaactacaggcacatggagggttttggtgtcaacacctacaccctaatcaataaggatggaaagcctcaccttgtcaaattccactggaagcctacctgtggtgtcaaatgcctgttggatgatgaagctgtgactgttggcggcacctgccacagccatgccacgaaggacttgactgattctattgcagcagggaattacccagagtggaagctttacatccagactattgatcctgatcatgaggacagatttgacttcgatcctcttgatgtcaccaagacatggccagaggatatcatccccctgcagccagttggacggatggtcctgaacaaaaacattgataacttctttgcagaaaatgaacagcttgctttctgcccagcgataattgtccctggaatccattactctgatgataagctgctccagacaagaattttctcctatgctgatacccaaaggcaccgtcttggcccaaactatttgatgcttcctgtgaatgcaccaaaatgtgcataccacaacaaccaccacgatggctccatgaatttcatgcacagggatgaagaggttaactacttcccttcaaggtttgatgctgcacgtcatgctgagaagtgtgtcattgacaaggagaacaatttccaacaggctggtgagagataccggtcatttgaccctgccagaggcaagatcgttttctccagcggtgggttgatgctctctcagatcctcgtattacacatgaactccgtggcatctggatctcctactggtcgcagcagtgtgatgcgtcccttgggcagaagctggcttcacgtctcaacctgaaaccaaacatgtag

SEQ ID NO: 76 - protein, 582 aa, Oryza sativa
  misc_feature (37)..(37): Xaa = any naturally occuring amino acid
MFVVRDKHAHQPKQVPVSLPVGPTHPKTAINKQTRRXRREGRPARSILARYETPLLFVPKLHYKKGRPFLLSSSLSPPIRSSSLLFSSSPHPVRFSSLPQQITMDPYKRPSSGSNSTFWTTNSGAPVWNNNSALTVGERGPYPPLEDYHLIEKLAQFDRERIPERVVHARGASAKGFFEVTHDISHLTCADFLRAPGVQTPVIVRFSTVVHERGSPETLRDPRGFAVKFYTREGNFDLVGNNMPVFFIRDGMKFPDMVHAFKPSPKTNMQENWRIVDFFSHHPESLHMFSFLFDDVGIPLNYRHMEGFGVNTYTLINKDGKPHLVKFHWKPTCGVKCLLDDEAVTVGGTCHSHATKDLTDSIAAGNYPEWKLYIQTIDPDHEDRFDFDPLDVTKTWPEDIIPLQPVGRMVLNKNIDNFFAENEQLAFCPAIIVPGIHYSDDKLLQTRIFSYADTQRHRLGPNYLMLPVNAPKCAYHNNHHDGSMNFMHRDEEVNYFPSRFDAARHAEKCVIDKENNFQQAGERYRSFDPARQDRFLQRWVDALSDPRITHELRGIWISYWSQQCDASLGQKLASRLNLKPNM

SEQ ID NO: 77 - DNA, 456 bp, Oryza sativa
  misc_feature (130)..(130): k = guanine or thymine
atggttgttgcatcagcagcagtcgccgtgcgagtccagtgcgttgttcgcgacgttcgaccacgacggcgacggcagatctccgcggcggagctgcggctgtgcatgaagacgacgctcggggaggagktttcggacgaggaggcggggcagctggtggcgtcggtggacgcggacggcgacgggctgctgtgcgaggcggagttcgtgcggctggtgcaggcggcggaggtggaggaggaagacgagcggcggggcaccggcctccgggaggcgttcggcatgtacgagatggaaggggaagggtgcatcacgccgacgagcctcaggcggatgctgcgccggctgggctccgaccaggacatcgacgactgccgcgccatgatctgcaggttcgatctcaacggcgacggcgtcctcagcttcgacgagttcaagatcatgatgaacgcctaa

SEQ ID NO: 78 - protein, 151 aa, Oryza sativa
MVVASAAVAVRVQCVVRDVRPRRRRQISAAELRLCMKTTLGEELSDEEAGQLVASVDADGDGLLCEAEFVRLVQAAEVEEEDERRGTGLREAFGMYEMEGEGCITPTSLRRMLRRLGSDQDIDDCRAMICRFDLNGDGVLSFDEFKIMMNA

SEQ ID NO: 79 - DNA, 603 bp, Oryza sativa
atgagtaaaataagcaaggaaaaacggggctacttgcatcagacgaaaaccaacctcctttcatcgccctatcacccgtccaagtccaacatatttcatcaaccattatttagtctaattctgcctaaattcatgggaggcttgggttttcgggatatgaggcttttcaaccaagctctcctagccaggcaagcttggcgcctgattcagtttccggatagcttatgcgccaggttgttgaaggctaaatatttccctaacagtgagttaatagatgctgttttcctgggtgactcatcggtgacttggaagagcctggaatatggtcttcaattgctgaagaaaggtctgatttggcgtattggagatgggacaaaagtaagaatctggcatgatcggtggataccgagtgaatcctcgcttatgttagctggtgttgctggaaggtgtcgccttcgttgggtttcccagttaataaagcaagatgatcgttcctgggatgcggatctgatctggcgaatatgcaatccttttgatgccatagaaattctcaaaattaaactgcctcaatatcagacaggattttcttgcgtggcattatga

SEQ ID NO: 80 - protein, 200 aa, Oryza sativa
MSKISKEKRGYLHQTKTNLLSSPYHPSKSNIFHQPLFSLILPKFMGGLGFRDMRLFNQALLARQAWRLIQFPDSLCARLLKAKYFPNSELIDAVFLGDSSVTWKSLEYGLQLLKKGLIWRIGDGTKVRIWHDRWIPSESSLMLAGVAGRCRLRWVSQLIKQDDRSWDADLIWRICNPFDAIEILKIKLPQYQTGFSCVAL

SEQ ID NO: 81 - DNA, 1203 bp, Oryza sativa
  misc_feature (85)..(85): y = cytosine or thymine
  misc_feature (87)..(87): y = cytosine or thymine
  misc_feature (96)..(96): y = cytosine or thymine
  misc_feature (102)..(102): s = guanine or cytosine
  misc_feature (837)..(837): r = adenine or guanine
  misc_feature (864)..(864): s = guanine or cytosine
atggctgcagtgacggtggagatcacgcggagcgaggtgctcaggccgtcgccggcgtcggccggcggcggcgaaatggtcccgytyaccgtcttygaccgsgccgccacggacggctacatcccgaccatgttcgcctgggacgccgcggcggcggcggcgctgtccaacgacgccatcaaggacggcctggccgccgtgctgtcccggttcccgcacctcgccggcaggttcgccgtcgacgagcgcggccggaagtgcttccggctaaacaacgccggcgcgagggtcctcgaggcctccgccgccggcgacctcgccgacgccctcgcgcacgacgtcgccgcccacgtcaaccagctctacccccaagccgacaaggatcgtgtggacgagccactgttgcaggtgcagctgacgcggtacacgtgcggcgggttggtgatcggcgcggtgagccaccaccaggtcgccgacggccagtccatgagcgtcttcttcaccgagtgggccgccgccgtgcgcaccgccggcgccgccctcccgacgccgttcctcgaccggtcggccgtcgcggcgccgcgcatcccgccggcgccggcgttcgaccaccggaacgtcgagttcaggggcgaggggagcaggagccactcctacggcgccctcccgctggagaggatgcggaacctcgccgtccacttcccgccggagttcgtcgccggcctcaaggcccgcgtcggcggcgcgcggtgcagcacgttccagtgcctcctggcgcacgcgtggaagaagatcacggcggcgcgcgaactctcgccgaaggattacacgcaggtragggtcgccgtcaactgccgcggccgsgccggcccggcggtgcccacggactacttcggcaacatggtgctctgggcgttcccgaggatgcaggtggccgccggcgacgagctcgcgccgacggcggcggagccgggcacggcgttctgcccggacctggaggtcgacagctggatagggttcaggttccacgacctcgacttcggcggcgggccgccgtgcgcgttcctgccgccggacgtgcccatcgacgggttgctcatcttcgtgccgtcgtgcgcggcgaagggcggcgtcgagatgttcatggcgctcgacgaccagcacgtcgaggctttgaggcagatttgctactccatggactga

SEQ ID NO: 82 - protein, 400 aa, Oryza sativa
MAAVTVEITRSEVLRPSPASAGGGEMVPLTVFDRAATDGYIPTMFAWDAAAAAALSNDAIKDGLAAVLSRFPHLAGRFAVDERGRKCFRLNNAGARVLEASAAGDLADALAHDVAAHVNQLYPQADKDRVDEPLLQVQLTRYTCGGLVIGAVSHHQVADGQSMSVFFTEWAAAVRTAGAALPTPFLDRSAVAAPRIPPAPAFDHRNVEFRGEGSRSHSYGALPLERMRNLAVHFPPEFVAGLKARVGGARCSTFQCLLAHAWKKITAARELSPKDYTQVRVAVNCRGRAGPAVPTDYFGNMVLWAFPRMQVAAGDELAPTAAEPGTAFCPDLEVDSWIGFRFHDLDFGGGPPCAFLPPDVPIDGLLIFVPSCAAKGGVEMFMALDDQHVEALRQICYSMD

SEQ ID NO: 83 - DNA, 1236 bp, Oryza sativa
  misc_feature (235)..(235): s = guanine or cytosine
atgctccagttcggccgccgcctcgcctaccacggcctccgccccaccctcgtcgccacccgctacgtgctctccacgagccctcctcccggcgaccccttccgcgtcgccgccttctccgacggcttcgacgccggcggcatggcctcctgccccgaccccgtcgagtactgccgccgcctcgaggccgtcgggtcggagacgctggcgcgggtcatcgacgccgaggcgcgcstggggaaggccgcgaccgtgctcgtctacgacccccacatggcgtgggtgccgcgcgtggcgcgcgccgccggcgtccccacggccgcgttcctgtcgcagccgtgcgccgtggacgcgatctacggcgaggtgtgggccggccgcgttccgctgccgatggacgacgggggcgacctccggcggcgcggggtgctcagcgtcgacctcgcgacggcggacttgccgccattcgtggcggcgccggagctgtacccgaaatacctcgacgtctcgatccggcaattcgaggacctgctcgacgccgacgacgtgttcgtcaactcgttcaacgacctcgagccgatggaggccgagcacatggagtcgacatggcgagccaagaccgtcggcccgacgttgccgtccttcttcctcgacgacggccggctgccggcgaacaagaaccacggcatcgacatcttcaccggtgatgcgccgtgcatggaatggctggataagcaggcaccctgctcggttgttcttgcctcctatggcacggtctactctctcgacggcgccgagctcgaggagctcggcaatggcctctgcaattccggcaagccattcctctgggtggtgaggtcgagcgaggggcacaagttatctgaagagcttcgtggaaagtgcaaggagaaggggttaattgtgtcctggtgtccccagcttgaggtcctgaaacataaggcaacagcgatgcctcagtcagcggaccaaccgactatagcgaagtacgtggaaaccgcatgggagattggtgtgagggcacgactagatgagaaaggctttgtcacggaggaggaggtggagatatccatcaagaaagtgatggatggggagagggcagcggagtacaagaggaatgcagctaagtggatgcaaaaagccaaggaagcagcacaagtaggcgggagctcagacaagaacattgctgaatttgtagcaaaatatttatcaaattag

SEQ ID NO: 84 - protein, 411 aa, Oryza sativa
MLQFGRRLAYHGLRPTLVATRYVLSTSPPPGDPFRVAAFSDGFDAGGMASCPDPVEYCRRLEAVGSETLARVIDAEARVGKAATVLVYDPHMAWVPRVARAAGVPTAAFLSQPCAVDAIYGEVWAGRVPLPMDDGGDLRRRGVLSVDLATADLPPFVAAPELYPKYLDVSIRQFEDLLDADDVFVNSFNDLEPMEAEHMESTWRAKTVGPTLPSFFLDDGRLPANKNHGIDIFTGDAPCMEWLDKQAPCSVVLASYGTVYSLDGAELEELGNGLCNSGKPFLWVVRSSEGHKLSEELRGKCKEKGLIVSWCPQLEVLKHKATAMPQSADQPTIAKYVETAWEIGVRARLDEKGFVTEEEVEISIKKVMDGERAAEYKRNAAKWMQKAKEAAQVGGSSDKNIAEFVAKYLSN

SEQ ID NO: 85 - DNA, 1185 bp, Oryza sativa
atggccgaggaggaggccgacaccatgacgaggtggttggcagaactggtagcgttgaatgtggctggccagcaaaggattgctagcgtggcggagaccggccctctcaagtttgacgtagctgggtacacggaagggttccctcaattgttctacttccaagattcctggaccaaggtgagcaacgtgatatttctggacgcgccggtggggacggggttctcctacgcccgtgaggaacaagggtacaacgtcaccctcacacagacgggacagcagctggtggtgttcctcaccaaatggctgggcgatcacccagagttcgcctcgaaccctctctacatcggcggcgactcctactccggctacaccgtcccagtgacggcgctccagatcgccaacgacgacgacgcccgggcgcggctgaacctcaagggctacctggtgggcaacgctgccacggacgtcaagtacgacagtgggggcaaggtgcccttcatgcacggcatggggctcatctccgacgagatgtacgaggccgcgcggagcagctgccgtggcgactacgtgtccaccccgaccaacgccgactgcgccaacgcgctgcaggccatcagcatggcaaccttcgccatcaacccggtgcacatcctggagcccatatgcggattcgcgctgcgcgggcgcgcgatgcctgagacgacgatggaccagcgcctgcgcctgggcctccccgtggagtgcagggacaacggctaccggctgtcgtacctgtgggcggacgacccggaggtgcgcgccacgctgggcatccacgagggctccatcgcctcctggagccgctgcacggcgctgccgctcttccggcacgacgtggacagcgccatcccctaccacgcggagctcacgcagcgcggctacagggcgctggtgtacaacggcgaccacgacctggacatgacgttcgttggcacgcagcagtggatccggacgctgggctacaacgtggtgaccgcctggaggccgtggtactccaaccgccaggttgccggcttcaccaccgtctacgaccacaacctcaccttcgccaccgtcaagggcggtggccacaccgccccggagtaccgccccaaggagtgcctcgacatgctcgacagatggacctctccggccggcgagctctga

SEQ ID NO: 86 - protein, 394 aa, Oryza sativa
MAEEEADTMTRWLAELVALNVAGQQRIASVAETGPLKFDVAGYTEGFPQLFYFQDSWTKVSNVIFLDAPVGTGFSYAREEQGYNVTLTQTGQQLVVFLTKWLGDHPEFASNPLYIGGDSYSGYTVPVTALQIANDDDARARLNLKGYLVGNAATDVKYDSGGKVPFMHGMGLISDEMYEAARSSCRGDYVSTPTNADCANALQAISMATFAINPVHILEPICGFALRGRAMPETTMDQRLRLGLPVECRDNGYRLSYLWADDPEVRATLGIHEGSIASWSRCTALPLFRHDVDSAIPYHAELTQRGYRALVYNGDHDLDMTFVGTQQWIRTLGYNVVTAWRPWYSNRQVAGFTTVYDHNLTFATVKGGGHTAPEYRPKECLDMLDRWTSPAGEL

SEQ ID NO: 87 - DNA, 168 bp, Oryza sativa
atggccaagctgcccattatcaccaaggccaaacgtccagcaacgagattcaagatccacgtcgaaagacttcttattggtctctccagcactgactgcagctacgacatgctcattaccacaggcaaccttaacaacagtgtgaccatggaaatcccacacaggtag

SEQ ID NO: 88 - protein, 55 aa, Oryza sativa
MAKLPIITKAKRPATRFKIHVERLLIGLSSTDCSYDMLITTGNLNNSVTMEIPHR

SEQ ID NO: 89 - DNA, 1542 bp, Oryza sativa
  misc_feature (7)..(7): k = guanine or thymine
atggacktcgcgtcgctgttcccgttcgcgctggcgctggtggcgatcccgatctcgctggcgctgctggaccggctgcggctggggcggatcccgccggggccgcggccgtggccgatggtggggaacctgtggcagatcaagccggtgcggtgccgcggcttcctggagtgggcggagaggtacggcccgatcgtgtcggtgtggttcggctcgtcgctgaacgtggtggtgtcgacgtcggagctcgccaaggaggtgctcaaggagaacgaccagctgctcgccgaccggccgcgcaaccgctccacgcagcgcttcagccgcaacgggatggacctgatctgggcggactacggcccgcactacatcaaggtgcgcaagctctgcaacctcgagctcttcacccccaagcgcctcgaggccctccgccccatccgcgaggacgaggtcaccgccatggtcgagtccgtccaccgcgccgtcacccagccagggtagtgaacataaaccaatcgtagtgaggaatcaccttgctatggtggccttcaacaatataacaaggctagctttcggcaagaggttcatgaatgcaaatggtgacattgattgaacaagggcgtgagtttaagactattgtcaacaatggaatcaagatcggtgcatctctttctgttgctgagtacatttggtatttgaggtggttgtgtccacttaacgaggagctttacaagacccacaacgagagaagggatcggctgaccaagaagatcatagatgagcatgcgaaggccctcaaggagagtggtgccaagcagcactttgtggatgctctgttcactctcagagaacagtatgaccttagtgacgacacagttattgggcttctatggggacatgatcactgctggaatggacaccacagtgatatcagtcgagtgggcaatggcagagctggtcaggaaccccagggtgcagaagaagctgcaggaggagctggaccgcgtcgtcggccgcgaccgcgtcatgtcggagaccgacttccagagcctcccttacctgaacgccgtcgtcaaggagtcgctccggctgcacccgccgacgccgctgatgctcccgcacaaggccagcacgaacgtcaagatcggcgggtacaacatccccaagggcgccaacgtgatggtgaacgtgtgggcgatcgccagggaccccaaggtgtggagcaacccgctggagtacaggccggagcggttcatcgaggagaacatcgacatcaagggcagcgacttcagggtgctccccttcggcgccggccgccgcgtgtgccccggcgcccagctcggcatcaacctcgtcgcctccatgatcgggcacctcctccaccagttcgagtggtctctccccgagggcaccaggccggaggacgtcaacatgatggagtccaacggcgtcgtcacgttcatgagcacgtcgctgcaggtcatcgccaagcccaggctcgacaacccggacctgtacaagaggttccctgtcgagatgtga

SEQ ID NO: 90 - protein, 512 aa, Oryza sativa
  misc_feature (3)..(3): Xaa = any naturally occuring amino acid
MDXASLFPFALALVAIPISLALLDRLRLGRIPPGPRPWPMVGNLWQIKPVRCRGFLEWAERYGPIVSVWFGSSLNVVVSTSELAKEVLKENDQLLADRPRNRSTQRFSRNGMDLIWADYGPHYIKVRKLCNLELFTPKRLEALRPIREDEVTAMVESVHRAVTQPGSEHKPIVVRNHLAMVAFNNITRLAFGKRFMNANGDIDEQGREFKTIVNNGIKIGASLSVAEYIWYLRWLCPLNEELYKTHNERRDRLTKKIIDEHAKALKESGAKQHFVDALFTLREQYDLSDDTVIGLLWDMITAGMDTTVISVEWAMAELVRNPRVQKKLQEELDRVVGRDRVMSETDFQSLPYLNAVVKESLRLHPPTPLMLPHKASTNVKIGGYNIPKGANVMVNVWAIARDPKVWSNPLEYRPERFIEENIDIKGSDFRVLPFGAGRRVCPGAQLGINLVASMIGHLLHQFEWSLPEGTRPEDVNMMESNGVVTFMSTSLQVIAKPRLDNPDLYKRFPVEM

SEQ ID NO: 91 - DNA, 1599 bp, Oryza sativa
atggagaggaagctccggaacaccgagaacgtcaccgtctccgacgtcggcgagttcaacggggccatctacgaggtcctcaaagccacggcggactacaccgccgccgcggcaaggaggttcggcaccggcgagatcagcttcgacccgacctacccggtcatctacagcatggcgtggtgcacgccggacatggcgccggggcgctgccgggcgtgcctggcggacaccatcgcccagatgcacgcctacttcaacccgaacgcgcagggcgccaggctcgtcggcgtgcggtgcgccgcgcggtacgagatttacccgttctacaccggccgcggcatggtgcaggtgccggtgagccggccgccggcggtgccgggaactcccgggaaaaagagtaaaactggtaagattcttgcaattgtactaccgatagtggcagctctacttgctagcgctatgatctgcttttgttgctggaggaggagaacaaaagctactaagctgtcactatcatattcttctcgttctgaggacattcaaaacatcgaatctcttattatggatctaccgacactacggattgccacagataactttgctgaaaacaacaaactaggtgaaggaggatttggtgaagtttacaagggatcctttcccggtggccaaaccatagctgtgaaaaggctctctcagagttctggacaaggcataggagagcttaaaaatgaactggttttaattgccaagctccagcacaagaatctcgtgaggctcgttggagtttgtttggaacaagaagagaagctacttgtctatgaatacatgcctaacaaaagtctagacacatttctttttgaccctgagaaacgcaaacaaatcgattgggcaaagaggttcatgataataaaaggaatcactggaggattgcaatatctgcatgaagattctcaattgaagataattcaccgtgatctaaaagcaagcaacgttctactggacgcaaatatgaaccctaagatttcagactttggcttggcaaggctttttggagatgatcagtcacaagaaacaactaaccgcgttgttggaacttatggatacatggcaccagaatacgctttacgtgggcaatattcaataaagtctgacgtatacagcttcggtgtgttgcttttggagatcatcacaggaagaaaaaacagtgactcctacaactctgaacaagctgttgatcttctgagcctcgtatgggaacattgggcaatgaaaactatcacggagatggttgacccatatttgaggagtgattcttcctctctagatgagattttgaggtgcattcatgttggacttgtatgtgtccaagaggaccctatggataggccaactctgtcaatgatcaatatcatgcttgacggcaatacagtttcagctaaagctccatcgagacctgcatttttcacagaaatgttgggcaatattaatattggttcaagcatgtattcccaaccataccctgtaaccgactccacggccaagcactcgacggccatgtcactaaatgatgtgacagtaacagagcctgaaccaagataa

SEQ ID NO: 92 - protein, 532 aa, Oryza sativa
MERKLRNTENVTVSDVGEFNGAIYEVLKATADYTAAAARRFGTGEISFDPTYPVIYSMAWCTPDMAPGRCRACLADTIAQMHAYFNPNAQGARLVGVRCAARYEIYPFYTGRGMVQVPVSRPPAVPGTPGKKSKTGKILAIVLPIVAALLASAMICFCCWRRRTKATKLSLSYSSRSEDIQNIESLIMDLPTLRIATDNFAENNKLGEGGFGEVYKGSFPGGQTIAVKRLSQSSGQGIGELKNELVLIAKLQHKNLVRLVGVCLEQEEKLLVYEYMPNKSLDTFLFDPEKRKQIDWAKRFMIIKGITGGLQYLHEDSQLKIIHRDLKASNVLLDANMNPKISDFGLARLFGDDQSQETTNRVVGTYGYMAPEYALRGQYSIKSDVYSFGVLLLEIITGRKNSDSYNSEQAVDLLSLVWEHWAMKTITEMVDPYLRSDSSSLDEILRCIHVGLVCVQEDPMDRPTLSMINIMLDGNTVSAKAPSRPAFFTEMLGNINIGSSMYSQPYPVTDSTAKHSTAMSLNDVTVTEPEPR

SEQ ID NO: 93 - DNA, 630 bp, Oryza sativa
atggccggtagtagcgagcagcagctggtcgccaacgcggcggcgacgacggtggccgggaacgggagcaggttcgcggtgacgtgtggcttgctcaggcagtacatgaaggagcacagtggaagcaacggcggcggtggcttcttgccggcggtgacggccatgagcctcatgaccggcggcgctgatgcggaggaggaggcgccggaggtgaggaagaccatggagctcttccctcagcaggctgggacgctgaaagacacgcaagaaaggaaggagatcaccgagaaggcgcagctgaccatcttctacggcgggagcgtggtggtgttcgacgatttccccgccgagaaggccggcgagctgatgaaactcgccggctcccgcgacagcacggcggcggcggccgtctcagacgccggcgccgcagcggggcagccttgcctaccagacatgcccatcgcgaggaaggtgtcgctgcagaggttcctggagaagaggaagaacaggatcgtcgtggcggagccactgccggagtcggagaagaaggaggcggagtcgagcaagcgtgccaagaaagacgatggcggcgcgtcgtggctccaggtgaaccccactctcagcctgtga

SEQ ID NO: 94 - protein, 209 aa, Oryza sativa
MAGSSEQQLVANAAATTVAGNGSRFAVTCGLLRQYMKEHSGSNGGGGFLPAVTAMSLMTGGADAEEEAPEVRKTMELFPQQAGTLKDTQERKEITEKAQLTIFYGGSVVVFDDFPAEKAGELMKLAGSRDSTAAAAVSDAGAAAGQPCLPDMPIARKVSLQRFLEKRKNRIVVAEPLPESEKKEAESSKRAKKDDGGASWLQVNPTLSL

SEQ ID NO: 95 - DNA, 688 bp, Oryza sativa
atggggcagctggagctgtcccaccgggtggtgctcgcgccgctgacgcggtgccgctcctacggccacgtgccgcagccgcacgccgcggtgtactactcgcagcgcgccaccaacggcggactcctcatcgcggaggccactgtcatctcccccaccgcgcagggctacccggacacccccggcatctacacgcagcagcagatcgaagcgtggaaacccatcgtcgacgccgtccaccgcaagggcgccctcttcttcctacagatatggcacgtcggcagggtctccaccacaggatttccagccaaatggacaggcgccgatctcgagcaccgataagctctactgccacatggtggagccaggaatggccatcgtcgaaggacggaggaagatcacccatggtctcctgccattcaggaagcagttcaatggcactttcatcgctgctggcgggtatgaccgggaggaagggaacaaggtggtggctgatggctatgccgatctcgtcgcctacgggaggctcttcttggctaaccctgacttgccgaggaggtttgagcttgacgcaccattgaacaggtatgacaggtctaccttttatacacaggatcccgttgttggttatacagattacccttttcttgaggagattgatgaggagtcaacaactacctatgcttaa

SEQ ID NO: 96 - protein, 113 aa, Oryza sativa
MGQLELSHRVVLAPLTRCRSYGHVPQPHAAVYYSQRATNGGLLIAEATVISPTAQGYPDTPGIYTQQQIEAWKPIVDAVHRKGALFFLQIWHVGRVSTTGFPAKWTGADLEHR

SEQ ID NO: 97 - DNA, 1005 bp, Oryza sativa
atggcggcggcggcttcggtggtggtgttgtgcgcgctggtcgtcctcgcggcggcggggggcgcgagcgcttggccggtgatgagcccgtcgtactacgaggcgtcgtgcccaagcgtgtacgacatcgtgcggcgcgtcgtccaggatgcgcgctgcaccgacccgcgcgcccccgccagcctcctccgcctccacttccacgactgcttcgtcaatgggtgtgacgggtcgctgctgctcgacgacttcggcgcgatgcagagcgagaagaacgcgcccccgaacaaagggtcggcgcgtgggttcgacgtggtggacggcatcaaggctgccctggagaacgcctgccccggcgtcgtctcctgcgccgacatcctcgccctcgccgccgagatctccgtcgagctgtcaggagggccgagctggaacgtgatgctggggaggagggacggcacggcggcgaacttcgagggcgccagagacctccccggaccgacggacgatctggacctcctgagacggaaattctccgaattcaacctcgacgacaccgacttcgtcgctctccagggcgcgcacaccatcgggagggcgcagtgcaggttcttccacgaccggctctacaacatcagcggcacggagcagccggaccagacgctggacatggcctacctcaacgagctccggcagagctgcccggcgagcgaccccgaaagcgcggcgctgcgcaacctcgacccgcccacgccggacgcgttcgacaatagctactacggcaacctcctgcgcaaccgcggcctgctccagtccgaccaggggatgctctccgcgccgggcggcgccgcctcgaccaccgcgcccatcgtcgtgtggttcgccggtagccaggacgacttcttcaggagcttcgcgacggcgatggtcaagatgggcaacatcagcccgctcaccgggagcatgggggagatcaggaggaactgcagggtggtcaaccgcggctga

SEQ ID NO: 98 - protein, 334 aa, Oryza sativa
MAAAASVVVLCALVVLAAAGGASAWPVMSPSYYEASCPSVYDIVRRVVQDARCTDPRAPASLLRLHFHDCFVNGCDGSLLLDDFGAMQSEKNAPPNKGSARGFDVVDGIKAALENACPGVVSCADILALAAEISVELSGGPSWNVMLGRRDGTAANFEGARDLPGPTDDLDLLRRKFSEFNLDDTDFVALQGAHTIGRAQCRFFHDRLYNISGTEQPDQTLDMAYLNELRQSCPASDPESAALRNLDPPTPDAFDNSYYGNLLRNRGLLQSDQGMLSAPGGAASTTAPIVVWFAGSQDDFFRSFATAMVKMGNISPLTGSMGEIRRNCRVVNRG

SEQ ID NO: 99 - DNA, 535 bp, Oryza sativa
atgcagcaccatatattgtcaaattacttggaactcaattatctaaagagcatttccagtagaacaaaactaaaaggaaaacgtgttgctaccttgtttactaagattaagcatccatgcagggaagagactccagttgaggccccacctgccccggttcttggagagccgatggacctgatgactgctctgcagcttgtgatgaagaagtcaagcgctcatgatgggctcgtgaaggggctccgtgaggcggccaaggccattgagaagcatgccgctcagctttgcgtgcttgctgaggactgtgaccagcctgattatgtcaagttggtcaaggcactctgcgctgagcacaatgttcacctcgttaccgtgcctagtgctaaaactcttggcgagtgggcaggggctttgcaagattgattctgagggcaaggcgaggaaggtcgtaggctgctcctgcgtcgttgtcaaggacttcggtgaagagtcagagggcctcaacatagtccaggactatgtcaagtcccactag

SEQ ID NO: 100 - protein, 177 aa, Oryza sativa
MQHHILSNYLELNYLKSISSRTKLKGKRVATLFTKIKHPCREETPVEAPPAPVLGEPMDLMTALQLVMKKSSAHDGLVKGLREAAKAIEKHAAQLCVLAEDCDQPDYVKLVKALCAEHNVHLVTVPSAKTLGEWAGLCKIDSEGKARKVVGCSCVVVKDFGEESEGLNIVQDYVKSH

SEQ ID NO: 101 - DNA, 1305 bp, Oryza sativa
  misc_feature (970)..(970): r = adenine or guanine
atggcggtgacccttcccagcgcgcgagaggcggcgaacggcggcagttggggagcaacagcggcggccgatcccggcgaggagacggcagatccggcgtcaccttcgccggatctggccatcccctggccggatccggccggatgggtgctggtggcggaggaggccgcggcgcggcgacgcgacaagggcggcggcgacggcacggtgtccgcagcggaggcggcagtgacggcgcggggacgcggcagcggtgacggcgtggcagctggtggcggccgccacgatggcgagatgcacgcgggcggcggtgctcgcgccgccggggcgggccgagcaacaacggcgacggcggcgcgaggctcgcagacggcggctaccgacagtgcggctggtgatgggcaacggcggcggtgccagtggcagccgcggctgcgacctgaggtaacagcggcaatgccgtcggtgcggaggcagaggcctcggagcttgtcgcagcggcggcgtcatcggctgctgtggcacggtgggaggaggcacgatggtgcgttcggcagcagcggctgcggtggcggtgaccacggtcgccggaggcgccggaggcatgggggcctcggacggctagctaagggggtggtagacggctacatcgggccggcacggcattgtttggaggaggggtcggagaccggcttggcgaagagtggcgcagtcaatgacagtggagccggctcggcgcgagaggcgcgagcggtggagttggaggccgccttggcacgagaggcgcggccgatggagggaggccggattggcgcgagaggcgcgtccggtggaggaggccggcttggcgcgagaggcgcggccggcggtggaggaggcgacctcggtgtgaggaggagctgccgcgcacggggctccacgggcgccgccgctgatggcgcgggaggcgacgcagctgctatcggcggarcggtgggacacgatgctaatgaaagcgagaccaagctactcctcattgaagccatcaatggctgccgcccgagcctcgagggtctcaccgtcgagcagattaccagcctcggatggatggcaaatgcacgcctcaagattgtcaacgaccgcctcaagaagctccatgaggaaggcctcataccagcatccgtgtcattgttgggcaccgaggtaccaacccagagggagggatggctgatggatgttgcaaggggcattggctcaatggggtacaatcggttcagaggtagtagcggaagcggcactgctggatacaatggtgacctggcttag

SEQ ID NO: 102 - protein, 433 aa, Oryza sativa
MAVTLPSAREAANGGSWGATAAADPGEETADPASPSPDLAIPWPDPAGWVLVAEEAAARRRDKGGGDGTVSAAEAAVTARGRGSGDGVAAGGGRHDGEMHAGGGARAAGAGRATTATAARGSQTAATDSAAGDGQRRRCQWQPRLRPEVTAAMPSVRRQRPRSLSQRRRHRLLWHGGRRHDGAFGSSGCGGGDHGRRRRRRHGGLGRLAKGVVDGYIGPARHCLEEGSETGLAKSGAVNDSGAGSAREARAVELEAALAREARPMEGGRIGARGASGGGGRLGARGAAGGGGGDLGVRRSCRARGSTGAAADGAGGDAAAIGGVGHDANESETKLLLIEAINGCRPSLEGLTVEQITSLGWMANARLKIVNDRLKKLHEEGLIPASVSLLGTEVPTQREGWLMDVARGIGSMGYNRFRGSSGSGTAGYNGDLA

SEQ ID NO: 103 - DNA, 996 bp, Oryza sativa
  misc_feature (12)..(12): m = adenine or cytosine
atggcgtcgctmaccgccgccctggccacgccggcggccgctgccctcctcctcctcgtcctcctcgccgcccccgcctccgccgccaacttcacctgcgcggcaccacctgcaagtccgccatcctctacacctcccccaacgccaccacctacggcaacctcgtcgcccgcttcaacaccaccaccctccccgacctcctcggcgccaacggcctcccccgacggcacgctttcctccgcccccgtcgccgccaattccaccgtcaaaatccccttccgctgccgctgcaacggcgacgtcggccagtcggaccgcctccccatctacgtcgtgcagccgcaggacgggctcgacgccatcgcgcgcaacgtgttcaacgccttcgtcacctaccaggagatcgccgccgcgaacaacatccccgaccccaacaagataaatgtcagccagacgctgtggattccgctgccctgcagctgcgacaaggaggaaggctctaacgtgatgcacctcgcctacagcgtcggcaaaggggagaacacgtcggcgatcgctgccaagtacggggtgacggagtccacgcttctcaccagaaataagatcgacgaccccacgaaattgcagatgggacagattctagatgtcccgctccctgtgtgccgttcatcaatcagcgatacctcagctgatcacaatctgatgctcctcccggatggcacctatggattcaccgcaggaaactgcatccgctgcagctgcagttcaactacctaccagctaaactgcactgcagtacagaacaagggatgcccgtcagtgccactgtgcaatggaacgctgaagcttggtgagacgaacggcaccggttgcggatcaacaacgtgcgcctacagtggttactccaacagttcatcgctcatcatacaaaccagccttgcaactaatcagacaacagcctgccagaattttgatgactggtttatccagctttga

SEQ ID NO: 104 - protein, 330 aa, Oryza sativa
MASTAALATPAAAALLLLVLLAAPASAANFTCAAPPASPPSSTPPPTPPPTATSSPASTPPPSPTSSAPTASPDGTLSSAPVAANSTVKIPFRCRCNGDVGQSDRLPIYVVQPQDGLDAIARNVFNAFVTYQEIAAANNIPDPNKINVSQTLWIPLPCSCDKEEGSNVMHLAYSVGKGENTSAIAAKYGVTESTLLTRNKIDDPTKLQMGQILDVPLPVCRSSISDTSADHNLMLLPDGTYGFTAGNCIRCSCSSTTYQLNCTAVQNKGCPSVPLCNGTLKLGETNGTGCGSTTCAYSGYSNSSSLIIQTSLATNQTTACQNFDDWFIQL

SEQ ID NO: 105 - DNA, 890 bp, Oryza sativa
  misc_feature (590)..(590): s = guanine or cytosine
  misc_feature (599)..(599): s = guanine or cytosine
  misc_feature (601)..(601): y = cytosine or thymine
  misc_feature (604)..(604): s = guanine or cytosine
atggcaaagcatggtgttgcttccattttaacactggcactggtccttggagtacttgcggtcactcctaaagcggctcaaacatcgccctcaccatgggcgtcgccaacgagaacctctccgcgttcgcctccgacccctccgccgtggccaattgggtcaagcagaacgtccaggtctacccgggcgtcaacttccgctacatcgccgtcggcaacgaggttgagagcggcaacacgcagaacgtcctcccggccatgcagaacatgaacagcgcgctctccgctgccggcctcagcaacatcaaggtgtccgtgtcggtgtcccagaagggcgtgctcgccgggtacccgccgtccaatggcatgttctcccccgaagcgacctcgtacatgacgcccatcgcgaagtacctggcgagcaccggcgcgccgctgatggccaacgtctacccctacttcgcctacgtgggcaacctgcgggcccagatcgacgacatcaactacgcgctcttcacgtcgccgggcacggtggtgccggacggcagcaaggcttaccagaaccagttcgacgccatcgtcgacccggcsccgggagcstyccsatcgtggtgtcggagagcgggtggccgtcggccggcggcacggcggcgagcgccagcaacgcgcagacgtacaaccagaacctgatcaaacacgtcgggcaggggacgcccaagagggccgggagaatcgagatctacattttcatgttcaacgagtacgacaagaaaggcgccgacaccgagaagcacttcggcctcttcaacccggatcagtcgccggcctacaccattaatttctaaagagaacagcacttacaggctccatacaattaaggacatcgatgag

SEQ ID NO: 106 - protein, 280 aa, Oryza sativa
  misc_feature (172)..(181): Xaa = any naturally occuring amino acid
  misc_feature (183)..(183): Xaa = any naturally occuring amino acid
  misc_feature (186)..(186): Xaa = any naturally occuring amino acid
  misc_feature (236)..(236): Xaa = any naturally occuring amino acid
SGSNIALTMGVANENLSAFASDPSAVANWVKQNVQVYPGVNFRYIAVGNEVESGNTQNVLPAMQNMNSALSAAGLSNIKVSVSVSQKGVLAGYPPSNGMFSPEATSYMTPIAKYLASTGAPLMANVYPYFAYVGNLRAQIDDINYALFTSPGTVVPDGSKAYQNQFDAIVDXXXXXXXXXXGXGSXPIVVSESGWPSAGGTAASASNAQTYNQNLIKHVGQGTPKRAGRIEIYIFXMFNEYDKKGADTEKHFGLFNPDQSPAYTINFFNPDQSPAYTINF

SEQ ID NO: 107 - DNA, 3852 bp, Oryza sativa
atgggtgtcgcgccttcgggccggcccggcacggcccgagtcgtgttaggtcgtgcctgggccgatgcttcagcacgtgggctggcaaagcccagtgtgttgatttttcggcttataataaacctaaataaggagggccttaagattccttatgtggcttcatgcgacgtgcatgtggtccacgcattccgtcgctttcggttctccttgtgcccaacaaacacactgctgactgctgatgtccttctgttgcattgcacacaccgaatcattgaggttcatcggtgctctttgcttgcaagcgacaaagccattccaacgaatatccacagaaatatccgccccaaatcatttcccgcaacagcagccagccagctgttcgtcctagggccggccacgcgctactactaccgctgcggcgacagctccgtccgcggcggcgcggggctcagcggcgagctatccttcgagacgctcccctcctccgccgccgcggcgtaccctcgccgggtggcggtggtgggggacctggggctgaccggcaactcgacgtccaccgtcgaacacctcgcccgcaacgacccgtcgctggtggtcgtggtcggcgacatgacctacgccaaccagtaccgcaccaccggcggcagaggcgtcccctgcttctcctgctccttccccgacgcgccgctccgggaatcctaccaaccgcgatgggatggctggggaaggttcatggagccgctcacttcgaggatcccaatgatggtgatcgaagggaaccatgagatcgaaccacagggacaaggtggagcggtgacctttgcatcctacctggcaagattcgccgttccatccgaggagtctggctctaacaccaagttctactactcgttcaatgccgggggcatccatttcatcatgctcggtgcctacgtcgactacaaccggacaggagcccagtactcgtggttagagaaggatctgcgaaagattgatcgacgagtcacaccttgggttgtggctgcttggcacccgccctggtataacagctattcctcgcactaccaggaatttgagtgcatgagacaagcaatggaagggctcttgtaccaacatggtgtcgacattgtcttttcagggcatgtgcatgcttatgagaggatgaaccgggtgttcaactatactctcgacccctgtgggccggtctacattaccattggagatggagggaacattgagaagattgatatcgatcatgctgatgatcctggaaaatgtcccggtcctggtgacaaccaccctgaatttggtggagtctgccatctcaacttcacctctggtcctgccaaggggaaattttgctgggagaaacagccggagtggagcgcgttcagggagagcagtttcggacatggcatcctagagttgtcacgtgtacgagtgcaggtggttaattctacatatgcattatggacatggcaccgtaaccaggatgcatatggagaagacagcgtgggggatcaaatctatatagttcggcaaccggacaaatgcttgcttcagactacgatccccctgaaggatgcccttctctatcatatggatgatcttgatcagcacagttttcatgaagggaaatttgtgctctcgtttctagcctggattggtcaacaaacaagaggaaccaaagcaccagcgaaccaagatgttatactcaagcctacatcggcggtcatcgaggcgagcagacaaatccaaggcgtcccgagcaaaggaatcgattccgctcgcctgatgcctcgtcctcccccattgaatctcccccaagcggcagcgcgtaatcttccgggagtggtggccaaaagttgccggaagagtgctgtaccccatcgatttcagtcgagctgcaacggagcagcccacagtgctcttgatctgttcgtgtcatcctcgaagacggtaaaagtcaggccgacatgctcgctgcgcatgtcgtcatcggctcctgtccagcctgccagctttccgcacgtgggcgagtccgtcgtcgtacatcccgtgtggcacagaagtggcgagattcgcaacaaggccgccaatctggagtctggtgagggttcctgcgactcctacacctccgacgcgggcaccgccaaggctggagaggacaatgtgctacatgccgccaatgccctaactaaggtggtgccaattctccagaagcggttatcaagttcgttcagcgatagatgtcggatggccgtttccgctggagtgatatggagctccgcttgtttctggaaagttgcttggaggaaattgcagcttacaacatcaccaccagcaaccccaagccggtggcattggacaattttggctaagaaaatgtatgagaagtgtcgtaagaaggtgaacaggagccaaattcaatatatttggcatgggtgttggaagcggttgaacatgtgggtgtggcttgagtcgcaggctgccggccttggtcgtgatccgcacatgtctgccattgttgtcgacggtgggaaatataagataggtacacaagttggcaatggctattctgtcaatgaaaactatatccatgagtacccttggatgaagaaaggtatgagcaccttcaaaaatgatcctctcaagcacattgagcttcaccacgcggtgttcaaggggtgcaccgttgtcggcaaccattccgacgttgatggagcagcaagcaccgtcagaagatgcagttcagtggcaaacagtagatgttgctcagctcacagccgcttacaggcctccatgccatctccaatacacctcaaactacgacaagggataagggagatagggcagtcactggaagtgctgcttcagaggggtcttcaaagaagtcctagcgactccaccgggatgagatttctggcaccgtacccacatgtacgataccacagggatcaacttggtgctgaaggtgcacccccaccggtaggaccagaagagacattcaaccaccaacactcgtcgttgcgaagtattgttgaaagaacatttggcatcataaaaaaacaatggaaaatactgaaggaaatatcttacttccgagatcagattgctcccctcgtcctctacggcaagctcaataggacccacaacaagcattcccttagttcccataaaattgctaatgacacagtaaaatatgggttttcactggcggccggcaacaccacaaccgaggctaaggtgcacggctactccaccatcgtcagccgccatcaccgcctagctcttgagtccgatgatgatggatacacccctaccgagctcagcgatagtggatccggcactcctgagcccggcgatggcggatgcgcctctcccgacctcgctgaaggcatatcagtgtcgcccaagcttattgcagcccttgccgcgccttgccatattaaccgtcgtcgagccaattcgctgccagatctagcgccggtcgccagccccctttgctgctatcgccgctggtggcctcatctccttcggacagatctaggagagggaggggagaggaccaaatccgggagagagatgggaggcggcttcatcgctgtcgctccatccatcgatgctccccttcctccacctctccatccctcccctttgccgctgttggtatttcttaacgacattactagaaatataattcccagcaatggcacaaaaatattactgagaccacccctgattgccgagtttcttacgacaacccgtcatggccgtccaaccggaaatgaatacggaggaataccaattaacttaggactatatactaacgtggatgaatacccgtactga

SEQ ID NO: 108 - protein, 1283 aa, Oryza sativa
MGVAPSGRPGTARVVLGRAWADASARGLAKPSVLIFRLIINLNKEGLKIPYVASCDVHVVHAFRRFRFSLCPTNTLLTADVLLLHCTHRIIEVHRCSLLASDKAIPTNIHRNIRPKSFPATAASQLFVLGPATRYYYRCGDSSVRGGAGLSGELSFETLPSSAAAAYPRRVAVVGDLGLTGNSTSTVEHLARNDPSLVVVVGDMTYANQYRTTGGRGVPCFSCSFPDAPLRESYQPRWDGWGRFMEPLTSRIPMMVIEGNHEIEPQGQGGAVTFASYLARFAVPSEESGSNTKFYYSFNAGGIHFIMLGAYVDYNRTGAQYSWLEKDLRKIDRRVTPWVVAAWHPPWYNSYSSHYQEFECMRQAMEGLLYQHGVDIVFSGHVHAYERMNRVFNYTLDPCGPVYITIGDGGNIEKIDIDHADDPGKCPGPGDNHPEFGGVCHLNFTSGPAKGKFCWEKQPEWSAFRESSFGHGILELSRVRVQVVNSTYALWTWHRNQDAYGEDSVGDQIYIVRQPDKCLLQTTIPLKDALLYHMDDLDQHSFHEGKFVLSFLAWIGQQTRGTKAPANQDVILKPTSAVIEASRQIQGVPSKGIDSARLMPRPPPLNLPQAAARNLPGVVAKSCRKSAVPHRFQSSCNGAAHSALDLFVSSSKTVKVRPTCSLRMSSSAPVQPASFPHVGESVVVHPVWHRSGEIRNKAANLESGEGSCDSYTSDAGTAKAGEDNVLHAANALTKVVPILQKRLSSSFSDRCRMAVSAGVIWSSACFWKVAWRKLQLTTSPPATPSRWHWTILAKKMYEKCRKKVNRSQIQYIWHGCWKRLNMWVWLESQAAGLGRDPHMSAIVVDGGKYKIGTQVGNGYSVNENYIHEYPWMKKGMSTFKNDPLKHIELHHAVFKGCTVVGNHSDVDGAASTVRRCSSVANSRCCSAHSRLQASMPSPIHLKLRQGIREIGQSLEVLLQRGLQRSPSDSTGMRFLAPYPHVRYHRDQLGAEGAPPPVGPEETFNHQHSSLRSIVERTFGIIKKQWKILKEISYFRDQIAPLVLYGKLNRTHNKHSLSSHKIANDTVKYGFSLAAGNTTTEAKVHGYSTIVSRHHRLALESDDDGYTPTELSDSGSGTPEPGDGGCASPDLAEGISVSPKLIAALAAPCHINRRRANSLPDLAPVASPLCCYRRWWPHLLRTDLGEGGERTKSGREMGGGFIAVAPSIDAPLPPPLHPSPLPLLVFLNDITRNIIPSNGTKILLRPPLIAEFLTTTRHGRPTGNEYGGIPINLGLYTNVDEYPY

SEQ ID NO: 109 - DNA, 1167 bp, Oryza sativa
atggccgatcccaacggccgccgccgcctccccaccggtgatccagatcaagccaacgcctccccgtcccggcgagtctccgccgtcgatggcgtcaccggcggcgagggcaggcccacctactcccacttcccccccggcgcgtacgagccgacggacgtggcctacggcatccgcgacgcggccaacgacgagcgggcgcgggcgcgggctcgggctcgccatgaccagggtggcggggctcatgaccaccaccacgaccggccccggcaagaccagcgcggcgaggctcacctccacgacctccccggcgagaagagcgaggtccccgacgtcggtccatctgaccaacaggggaaggaagcctccgacaccgacatggctccattggcggcgctggcaaagagatcctacgacgtcaacttcccgccgctgcacgagcaccgcgccgcccccttccccgccccggcacccgcattcgcacccgcaccggcgggcaccatgggatcctcttccgcacaggtgcagggtgacggggctcctgacaatcacgaccacgacccacgtcacctaccccggcaagaccagagcggcggagctcaccccgacgacctccacggcgagaagaccatcggttcaggctccgatatcctcgacgactccaagagaggaatgatcaacgccggtccccaacacggccgcatcaccacctccaatggcggcagcggcagcggcagcgacaagggcaagggggtctcctacgccggggacaagcccgcatctagctcgtcgtcctccagctctgctggccagcaggggagcgacaccgacaaaactccttcggcggcggcggcgagctcctacgccgtcaacttcccgccgctgctgcccgcacccgctcccgtcccggcccccgcacccgcacccgcggtcgccggcgccatgggtgttgccaatgcccaccacaagattgcgctgtgcagcaagtggaggaaggggaggtgccacaacggggcagcgtgtcgctactctcatggcgaggaggagcaacgaattgtgccggagatgagagtcggcggcgggggacgtccgtgcccggagctcgccgccgccaagggatggtgcaggtacgggctcaactgcaagtattgccatggcggcgtatag

SEQ ID NO: 110 - protein, 388 aa, Oryza sativa
MADPNGRRRLPTGDPDQANASPSRRVSAVDGVTGGEGRPTYSHFPPGAYEPTDVAYGIRDAANDERARARARARHDQGGGAHDHHHDRPRQDQRGEAHLHDLPGEKSEVPDVGPSDQQGKEASDTDMAPLAALAKRSYDVNFPPLHEHRAAPFPAPAPAFAPAPAGTMGSSSAQVQGDGAPDNHDHDPRHLPRQDQSGGAHPDDLHGEKTIGSGSDILDDSKRGMINAGPQHGRITTSNGGSGSGSDKGKGVSYAGDKPASSSSSSSSAGQQGSDTDKTPSAAAASSYAVNFPPLLPAPAPVPAPAPAPAVAGAMGVANAHHKIALCSKWRKGRCHNGAACRYSHGEEEQRIVPEMRVGGGGRPCPELAAAKGWCRYGLNCKYCHGGV

SEQ ID NO: 111 - DNA, 573 bp, Oryza sativa
atgagtacacgcatgggagagggattttatttcattttcagtcgcaaaattgacgggatgcaaatgattctttgcacccactactttctaaaagctagcaagcacaaacatatatggagattaggcaatgctgcaaatgttgggcccacatgcatcctaatgtttcgtgatatcatccttacctcgaaaattcacaacacaataaatcttctccttgatttcaatctcatcatcgccatgggcaactgcctagtgatccaagacgacagagacaaggagatcaagatcatgggaatggacggcggcgagatcctcaagctgcaccgggatgccgccgtctccgactccgacgaccccgcggccgacatggcgaaggcagcagctgctgccgccgccgccgccgctgccgatacggccggcggcgtcgtccgggtgaagctggtgatcagcaagcagcagctgaagaagatgctgcacaaggatggcgtctctcttgacgacatggtttcgctgatgcagagagaagcaaaaaatttgaacgaagagaaaccagagggtgttccggcaaaatga

SEQ ID NO: 112 - protein, 190 aa, Oryza sativa
MSTRMGEGFYFIFSRKIDGMQMILCTHYFLKASKHKHIWRLGNAANVGPTCILMFRDIILTSKIHNTINLLLDFNLIIAMGNCLVIQDDRDKEIKIMGMDGGEILKLHRDAAVSDSDDPAADMAKAAAAAAAAAAADTAGGVVRVKLVISKQQLKKMLHKDGVSLDDMVSLMQREAKNLNEEKPEGVPAK

SEQ ID NO: 113 - DNA, 1071 bp, Oryza sativa
  misc_feature (131)..(131): k = guanine or thymine
  misc_feature (217)..(217): s = guanine or cytosine
  misc_feature (222)..(222): y = cytosine or thymine
atggcgtccaggactagtgctactgccggcatgctgctgctcgccgccgcggctgcgctggtgtgcagctcggcggcggcgaggatgccgccgttggcgaaggggttgtcgttgggctactacgacgcgakttgcccgcaggcggaggccgtcgtgttcgagttcctgcaggacgccatcgccaaggacgtcggcctcgccgcggcgctgatccggstccayttccacgactgcttcgtccagggctgcgacgcctccatcctgctcgacagcacacccaccgagaagagcgagaagttggcgccgccgaacaagaccctccgcaagtcggcgttcgacgccatcgacgatctccgcgacctgctcgacagggaatgcggcgacaccgtcgtgtcctgctccgacatcgtcaccctcgccgcccgcgactccgtcctcctcgccggtggcccgtggtacgatgttcccctcggccgccacgacggctccagtttcgcgtctgaggacgccgtcctgagcgcgctcccgtcgccggactccaacgtcaccacgctcctcgaagcgctgggcaagctcaagctcgacgcccacgacctcgtcgccctctccggcgcgcacaccgtcggcatcgcgcactgcacttccttcgacaagcgcctcttccctcaagtcgaccccaccatggacaagtggttcgccggccacctcaaggtcacctgcccggtgctgaacaccaacgacaccaccgtcaacgacatccggacgcccaacaccttcgacaacaagtactacgtcgacctgcaaaaccgccagggcctcttcacctccgaccagggcctcttcttcaacgcaaccaccaagccgatcgtcaccaagttcgccgtcgaccagtcggccttcttcgaccagtacgtctactccgtcgtcaagatgggcatgatcgaggtgctcaccggctcgcaggggcagatccgcaagcgctgttcggtgtccaacgccgccgccgccggcgaccgtgcttggtccgtcgtggagaccgtcgctgaggccgccgagagcttggtgctgtag

SEQ ID NO: 114 - protein, 356 aa, Oryza sativa
MASRTSATAGMLLLAAAAALVCSSAAARMPPLAKGLSLGYYDAICPQAEAVVFEFLQDAIAKDVGLAAALIRVQFHDCFVQGCDASILLDSTPTEKSEKLAPPNKTLRKSAFDAIDDLRDLLDRECGDTVVSCSDIVTLAARDSVLLAGGPWYDVPLGRHDGSSFASEDAVLSALPSPDSNVTTLLEALGKLKLDAHDLVALSGAHTVGIAHCTSFDKRLFPQVDPTMDKWFAGHLKVTCPVLNTNDTTVNDIRTPNTFDNKYYVDLQNRQGLFTSDQGLFFNATTKPIVTKFAVDQSAFFDQYVYSVVKMGMIEVLTGSQGQIRKRCSVSNAAAAGDRAWSVVETVAEAAESLVL

SEQ ID NO: 115 - DNA, 1091 bp, Oryza sativa
  misc_feature (18)..(18): k = guanine or thymine
  misc_feature (51)..(51): r = adenine or guanine
  misc_feature (729)..(729): r = adenine or guanine
atgaaggcgctcattctkgttggaggcttcggcactcgccttcggcctttracgctcagtttcccaaagcctcttgttgatttcgcgaacaagcccatgattctgcatcagcagattgaggccttgaaagaagttggagtaacagaagttgttttagccatcaactaccgcccggaggtaatgctcaatttcctgaaggactttgaggataagcttggcatcacaatcacgtgttcccaagagactgagcccttgggaactgctggccctcttgctctagcaagggacaagcttgtggatggatctggtgagccattctttgtcctcaacagtgacgtcataagtgaatacccttttgctgagctcataaaatttcacaagagccatggtggtgaggcaacgattatggtcaccaagaggtggacgaaccatcaaaatatggtgttgtggttatggaggaggtcactggaatggtggaaaaatttgttgagaaaccaaaaatatttgtaggcaacaagatcaatgcgggaatttacttgttgaatccatctgtcctggaccgcatcgagctgaagccaacttcaattgagaaagaggtctttcctcgaattgcatctgatgcaaagctctttgctctggtccttccaggtttttggatggatgttggccaaccaagggattacattacaggcttgcgcctttatctggattcacttaggaagagatcarccaacaggttagccactggagcacacattgttgggaatgtgctagttcacgagagtgcgaagattggcgaaggctgtctgattggtcctgatgttgctattggtcctggatgcgtcgtggaggatggtgtgaggctttcccgttgcacggtgatgcgtggcgtgcgtattaagaagcatgcttgcatatcaaacagcattattggatggcactcaactgttggacaatgggcacggatagaaaatatgactatcctaggagaggacgtacatgtaggtgatgaggtctataccaacggcggtgttattctcccgcacaaagagatcaaatcaagcatcctgaaacctgagattgtcatgtga

SEQ ID NO: 116 - protein, 364 aa, Oryza sativa
  misc_feature (140)..(140): Xaa = any naturally occuring amino acid
  misc_feature (157)..(157): Xaa = any naturally occuring amino acid
  misc_feature (245)..(245): Xaa = any naturally occuring amino acid
MKALILVGGFGTRLRPLTLSFPKPLVDFANKPMILHQQIEALKEVGVTEVVLAINYRPEVMLNFLKDFEDKLGITITCSQETEPLGTAGPLALARDKLVDGSGEPFFVLNSDVISEYPFAELIKFHKSHGGEATIMVTKXVDEPSKYGVVVMEEVTXGMVEKFVEKPKIFVGNKINAGIYLLNPSVLDRIELKPTSIEKEVFPRIASDAKLFALVLPGFWMDVGQPRDYITGLRLYLDSLRKRSXNRLATGAHIVGNVLVHESAKIGEGCLIGPDVAIGPGCVVEDGVRLSRCTVMRGVRIKKHACISNSIIGWHSTVGQWARIENMTILGEDVHVGDEVYTNGGVILPHKEIKSSILKPEIVM

SEQ ID NO: 117 - DNA, 451 bp, Oryza sativa
atggcggaccagctcaccgacgaccagatcgccgagttcaaggaggccttcagcctcttcgacaaggacggcgacgggttgtattactactaaggagttgggaactgtcatgcgttcgctggggcagaacccaactgaggcagaactacaagacatgatcaatgaggtggatgctgacggcaatggaacaatcgatttccctgaatttctcaacctgatggcccgcaagatgaaagatactgattctgaggaagagctcaaggaggcgttccgtgtgttcgacaaggaccaaaatggttttatctctgctgctgaattgcgtcacgtcatgactaaccttggtgagaagctgacagatgaggaggttgaagagatgatccgtgaggccgatgttgatggtgatgggcagatcaactacgatgaattcgttaaagtcatgatggccaagtaa

SEQ ID NO: 118 - protein, 149 aa, Oryza sativa
MADQLTDDQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVEEMIREADVDGDGQINYDEFVKVMMAK

SEQ ID NO: 119 - DNA, 5829 bp, Oryza sativa
atggcaaggccgtctcccgttgaggcaagcggtggtccggtgatgggagacatcaccggcggcggtggagagcttcgagtccagatagcagccaactccggcgggcaaggtggcaaggtcgtcggcgccgcgccggagaagtgtctgaatcgcttcgtccgcgtggtggcgctgatggagaggacgggcaacgccctcggcacgctggccttcacctgggctaccgtcatcctcctcggcggctaccccaccgtgcttgactcgaagccgaagaacaatagcgactattggttcacgacagtcatcgtattcatagaagccgcaaggatgttcagcagcgacaaatccgattatcagttgttcttccgagcaagaggtgctttcagattccttggaagcagtggactgattgcaatcgtattcttttgggatgcatacgcaatgctgggcatggttgcttcgaacttgcctgcctgggcacacaacttactttcaatcttgttaatactggtaccacttgcgattggccagcttctaagagcagctcgaagaccgaccacttttccagtacttgtatattacgacccgcgaatgcacaaaatcaatttcataaaccgattgaccgtgtggataccgtacatatttctctctgcgattgtgctcctagtaacgatcagcaggctgcagtacccaattatcacaaacctagtgcacggtgctctgggcagcaagcatgcattttggagtcggtttattctaatttcatgcatctttgctgcaatagtgatgctggttgtcatggttgatccagagtgtcgattaattatgatcgcgatcgcaatcatactgtcatttggcaacttacatatcccagcagcactcatgcgtgtcaacctcgcggggatgcgccttgcaaaacataactacttcggccaatggggagttgaatctgtcaatctatactacacatacgccttcgagaaaaacatggaaggaggtgtatttgctgcaaagaggatcagcctcagcaactttgccatggattctataaattctgacttgtccaagaaacagctgtatgggatctggatgatgcacatttttctgcagagagatccgaccagggcacagctactggagaaactgaccacttcaacgcagaccatggctaggttaatcagtatgctgggctggactagcagaaatgatcatacaactatcaggttatatgccgccaaggtaactgccgagcttgcaaagagcctccgagttgtaactgtccctgggacgatgtaccttgtttctacactcctggatactgacagaaaaccaaaaagaagacacccgcttctggatgaagatgatgatcgagatcctttatttgttgatacagtagaaagtcaggagaaaagtctggatgcagctggtgatcaagggcaaagacaagggtcagctggggacactgatatcatgctgaaaacaccaacccgatcaacgcacatgaacaacccaagatccacatacaaatgctgggaatccacatacaaatgctgggagaggatatcagagtaccagtcaattcccaaggagcgaccattaacagacgatgatcttctccctgcactaggcatgtcaattgtttatagccttgctggttgtgatcaaaataactgtgtggaaatcgacaaagtaactgacctgatcccaaaaatcattggattcacaagcttcagaagcgcaacgttaaattccgaagcacaacagaaggttctcataaagttatcactgcaggcgctgcagaggctcacaagcattgaaggggaaattggcatgacactgcggtacaagataacaaaacatcccttcttactgcgaaatcttgcagagatcttgagagacagcagcagtagcaatcaagaactaaggaggctcgtggcaggaatccttagaaatcttgccattgacagagacacaaggcaggagattggacaaatgcaagtgctcattaccaggctgatcaaagcattcctcgattccaacggaccatctagttcagatgttgattgcttgctgccaaaggtcgctgggcaagcactggtaatgctgtcattagaaaattcacataactgcttcgttatattgaaggaaccagagtttattaataaactaaaaaatatgatactaatccatgatgataaatacatatatgtggcagcaagcctgttgcgtaatatgtgcctgcacgctcaacccgagctcacagaattagacctaaaggaactatctcagaccttgcgagaggtgttggaaagaataatggacgctgaaggggcggaactagaaatcctgattggccttagttcacagatatgcaaactcattcctgaagaattttcccaacagctagagcatggacagattaagcggagattcattaagaggctagtggacacactgaatgcaaacatgaacccaagttctcattgccctgggatccggagggtggtacttgagcaatccatatacatgatggagtacaattctcactatgccaattgtttcaatgaataccagatgatggacgcactgtcaattgtagaattgacgccctcaagggctgagaattacatggttttcttgggtgacacaggtttcatggaatgtaacacacctctctctgccctagcggacagggcaaaagaactgatgggtcgtcagtggctgcaagtgattaaccccattcaacacaagttactatggctgagaaattcagaccatgacaatgcccaacttatggagtacaatgttccactttcttgttctgtggggagagcaacaatgttcattaattcggtggaggcagcccgcaggcagaggcatttgcccggaccgtacgaagtagacagaggtgtaacctttgcaggtaacctttcaactccctaccgttcctttaactgtgagcgagtctaccgtgcatcagttctcttaattagcatgatggcggccgacggcagcgttgtcgcggagcaccggatacagataccagccgtggcatcggagtcgggacaagctgatcataaggcggtcgccgcggcgccggagaagtggctgaacttcttcgttcgcttgctcgcggggatcgaaagcgtgggcaacgccttgggcacgctggccttcacctgggccaccgtcgtcctgctgggtggctacccgtccaatctcaagggcgattttggttttgcgactgcgatatttttcctagaagccacgaggatattcacccgcaacaatatgctggattatcaactgttcttccggacgagaggtgcctttagaccactgggctggaacgggctgatggtaatcgcaggcttctccgtttctatggtgtccacggttgtttgcaacgtactctgggcacgtatagggtttgaaattatggtagttttatttgcggctggccagtttctatgtgctggagttctaagactgcgcctacgcatcaacaatcggctacgccgtcagatatcgctgtggagcccagtggttgcactctcaatacttgcttcctgtatttacagagagcacaggagctcactggccatgcggatagtgtacggtttgctccttgtggttgtgctcctagtgactattagcaggctgcagttcccaattataatcaaccgagtacagggtgctttgggtcgcaaatacgtattttggcgcccatttatcctatactcgtgcatgctcgctgcaattgtgatgccgatgttcatgattgagaaattatattcgtctgcgatcatcgtcctcgacatatatgccttggtcgttgtgtcattcggcaacttgcagattccagcagcaatcgcgcgtgttgtgctcgcagggatgcaccttaatccaaagggctacgacggccatgcaaatcttgtcccatctctaaaaatgttctacgcaatggtgattgcccagggaatactttacatcattgccgcggtgttggagatcttctgcttcatccctcggagacacctcgtccgccatggtcagtggggagcggaatctgtcgatctgtactacgcatacgcctacgacaaatacatggaaggaggtctgtttgctccaaagaggatcagcctcggcaactttgccatggattctctgaattcggacctatccaagaatcagctatacgctgtccggatgatgcacacattactgcaaagtgatctgaccagggcacggttgctagagaaactcaccggttcaacacagacgatggccaggttaatcagcatgttggactggagtagtagacaccattgtacagctatcaggttatatgccgccaaggtcactgccgagctcgcaaagaacctccgagttggaactgtccctgggacattgcagcttgtatctactcttctggatgctgatggaaagccgaaaagagggcacccactcctggatgcagatggtgatcaagatcattttgttgatatattagatagacaagataaaaaacatgatatagctggtgaccaagagccgattgaggacaccgataacctgatggaaacaccaacccgatcaacgcacattaacgaccaaagatacatacctagaattttgcataggatactggcgtactggtcaattcccaaggagcagccattgacaaacgatgatcttctccctgcactaggcatgtcaatcatatatagccttgctggttgtgatcaaaataactgcgcgaaaatcgacaaagtaactgacctgatccccaaaatcattggattcacaagcttcagaagtgcaatggtaaattctgaagcacaacagaaggttctcttaaagtcatcgttgaaggtgttgcagaggctcacaagaattgacggcgaaatcgccataaaactgcggtataagatatcaaaacatcccttcttattgagaaaccttgcagagatcttgggagacagcaacagtaatcaagaactaaggaggctcgtggcaggaatcctcagaaaccttgcaattgacggagacacaaggcaggagattggacaaatgaaaatgcttattaccgggctgatgaaggcattcctcgattctaacggatcatttagttcagatgttgattgcttactgccaaagattgccaggcaagcactggtaatgctgtcatcagaaaatccgcacaactgcttcgttatgttgaaggaaccagatttcattcataaactaaaaaatatgatcctgatccatgatgacaaatacatatatgtggcagcaagtctattgcgtaatatgtgcctgcacgctcaatatgagctcacagaatcagacctaaaggaactatctcacacattgcaagaggtgttggaaagaacaatggacgctgagggggcagaactagaaatcctaattggccttagttcacagatatgcaaactcattcctgaagaattttcccaagagctagagcacgggcagatgaagcggagattcattaagaggctagtggacgcactgaatgcaaacatgaaaccaaatcctcattgccctgggatccggagggtgatactagagcaatgcatatacatgatggagtgcaattcttgctatgccaattgtttcaatgaattccgaatgatggatgcagtgtcgatggtcgaagagacaccctcaagggctgagaagtacatgtttttcttgggtgacatgggcttcatggaatgtaacacacctctctctgccctagtggagagggcaaaagaactgatgagtcgccagtggctgcatgccatcaacagtgccaactga

SEQ ID NO: 120 - protein, 1942 aa, Oryza sativa
MARPSPVEASGGPVMGDITGGGGELRVQIAANSGGQGGKVVGAAPEKCLNRFVRVVALMERTGNALGTLAFTWATVILLGGYPTVLDSKPKNNSDYWFTTVIVFIEAARMFSSDKSDYQLFFRARGAFRFLGSSGLIAIVFFWDAYAMLGMVASNLPAWAHNLLSILLILVPLAIGQLLRAARRPTTFPVLVYYDPRMHKINFINRLTVWIPYIFLSAIVLLVTISRLQYPIITNLVHGALGSKHAFWSRFILISCIFAAIVMLVVMVDPECRLIMIAIAIILSFGNLHIPAALMRVNLAGMRLAKHNYFGQWGVESVNLYYTYAFEKNMEGGVFAAKRISLSNFAMDSINSDLSKKQLYGIWMMHIFLQRDPTRAQLLEKLTTSTQTMARLISMLGWTSRNDHTTIRLYAAKVTAELAKSLRVVTVPGTMYLVSTLLDTDRKPKRRHPLLDEDDDRDPLFVDTVESQEKSLDAAGDQGQRQGSAGDTDIMLKTPTRSTHMNNPRSTYKCWESTYKCWERISEYQSIPKERPLTDDDLLPALGMSIVYSLAGCDQNNCVEIDKVTDLIPKIIGFTSFRSATLNSEAQQKVLIKLSLQALQRLTSIEGEIGMTLRYKITKHPFLLRNLAEILRDSSSSNQELRRLVAGILRNLAIDRDTRQEIGQMQVLITRLIKAFLDSNGPSSSDVDCLLPKVAGQALVMLSLENSHNCFVILKEPEFINKLKNMILIHDDKYIYVAASLLRNMCLHAQPELTELDLKELSQTLREVLERIMDAEGAELEILIGLSSQICKLIPEEFSQQLEHGQIKRRFIKRLVDTLNANMNPSSHCPGIRRVVLEQSIYMMEYNSHYANCFNEYQMMDALSIVELTPSRAENYMVFLGDTGFMECNTPLSALADRAKELMGRQWLQVINPIQHKLLWLRNSDHDNAQLMEYNVPLSCSVGRATMFINSVEAARRQRHLPGPYEVDRGVTFAGNLSTPYRSFNCERVYRASVLLISMMAADGSVVAEHRIQIPAVASESGQADHKAVAAAPEKWLNFFVRLLAGIESVGNALGTLAFTWATVVLLGGYPSNLKGDFGFATAIFFLEATRIFTRNNMLDYQLFFRTRGAFRPLGWNGLMVIAGFSVSMVSTVVCNVLWARIGFEIMVVLFAAGQFLCAGVLRLRLRINNRLRRQISLWSPVVALSILASCIYREHRSSLAMRIVYGLLLVVVLLVTISRLQFPIIINRVQGALGRKYVFWRPFILYSCMLAAIVMPMFMIEKLYSSAIIVLDIYALVVVSFGNLQIPAAIARVVLAGMHLNPKGYDGHANLVPSLKMFYAMVIAQGILYIIAAVLEIFCFIPRRHLVRHGQWGAESVDLYYAYAYDKYMEGGLFAPKRISLGNFAMDSLNSDLSKNQLYAVRMMHTLLQSDLTRARLLEKLTGSTQTMARLISMLDWSSRHHCTAIRLYAAKVTAELAKNLRVGTVPGTLQLVSTLLDADGKPKRGHPLLDADGDQDHFVDILDRQDKKHDIAGDQEPIEDTDNLMETPTRSTHINDQRYIPRILHRILAYWSIPKEQPLTNDDLLPALGMSIIYSLAGCDQNNCAKIDKVTDLIPKIIGFTSFRSAMVNSEAQQKVLLKSSLKVLQRLTRIDGEIAIKLRYKISKHPFLLRNLAEILGDSNSNQELRRLVAGILRNLAIDGDTRQEIGQMKMLITGLMKAFLDSNGSFSSDVDCLLPKIARQALVMLSSENPHNCFVMLKEPDFIHKLKNMILIHDDKYIYVAASLLRNMCLHAQYELTESDLKELSHTLQEVLERTMDAEGAELEILIGLSSQICKLIPEEFSQELEHGQMKRRFIKRLVDALNANMKPNPHCPGIRRVILEQCIYMMECNSCYANCFNEFRMMDAVSMVEETPSRAEKYMFFLGDMGFMECNTPLSALVERAKELMSRQWLHAINSAN

SEQ ID NO: 121 - DNA, 651 bp, Oryza sativa
  misc_feature (25)..(25): m = adenine or cytosine
atggagtcttgggcccacaaacccmataagatcatatttaaatgggccaactccagagaaatactaaaggggatccaactccaggagaaggcagttactaccgacctcccaataacggttgtgactgtttccgacgctccaaccgtcatcaggagaacagatgaggtggtaacagcccttaagatcaccgtagtcctccctatccggacactgttccttactggtaaatcctctcaatcctttgccatttttggctttgtgtccttggatgatattgaagaggagatgaacacacacgttcccttacagaaacctttcggccatcaccattgtacactgaaggagaaatcagaattggcgatgtcaacttggatagctgacgaggacgctgccctcctcttgtctgagtccatccggttaaacccatgcggctgcaccaccggcgccacgggcaccgggtacatgtccgtgacctctccggcgaaccccagcaatgccggtgcgctcggcggatcttccctgtgcttgtgcagcaggtgcaccggcgacgagcagcggctccgtgtcagcgacgcccctctgctcggtgtcgtgtcgccgctcatctgtgctaggacagctgctcctcgaagattacatgactggtcatga

SEQ ID NO: 122 - protein, 216 aa, Oryza sativa
MESWAHKPDKIIFKWANSREILKGIQLQEKAVTTDLPITVVTVSDAPTVIRRTDEVVTALKITVVLPIRTLFLTGKSSQSFAIFGFVSLDDIEEEMNTHVPLQKPFGHHHCTLKEKSELAMSTWIADEDAALLLSESIRLNPCGCTTGATGTGYMSVTSPANPSNAGALGGSSLCLCSRCTGDEQRLRVSDAPLLGVVSPLICARTAAPRRLHDWS

SEQ ID NO: 123 - DNA, 1799 bp, Oryza sativa
  misc_feature (87)..(87): r = adenine or guanine
  misc_feature (166)..(166): s = guanine or cytosine
atgaaggtgatcgagaagatccaggaggcggcggcggatgggcggacggtgttctcgttcgagtacttcccgcccaagacggaggargggctcgacaacctgttcgagcggatggatcgcatggtggcgcacggccccaacttctgcgacatcacctggggcgccsggggatccaccgccgacctcaccctcgagatcgccaaccggatgcagaacatgggtgtgtgtggaaacaatgatgcacctgacatgcaccaatatgccagttgagaagattgatgatgccttaacaacaataaagtctaatgggattcaaaatgttctggctcttaggggtgatcctccacatggtcaggacaaatttgttcaagttgctggtggattcgcttgtgctcttgatttggtacaacacattagagccaagtatggtgattattttggtattactgttgctggttatccaggaggcccacccggatgcaatacaaagtacggaaggggctacaccagaagcatacagcaatgatcttgcttatttgaagcaaaaggttaggttgatgctggtgctgaccttatcattacacagcttttctatgacactgatatctttctcaagtttgtgaatgactgccgccaaattggcataacttgccccattgttcctggcataatgcctataaataactacaaaggtttcctgcgcatgacagggttctgcaaaactaagagataccagctgagatcactgctgcactggaacctattaaagataacgaggaggcggtcaaagcatatggaatccaccttggtactgaaatgtgcaagaaaattttagctactggaatcaagaccttgcacctttacacgctaaacatggagaagtctgctctaggaatattgatgaaccttggattaattgaggagtccaagatctcaaggtcattgccttggaggcccccaacaaatgttttccgtgtcaaggaggatgtccgccctatattctggggctaacagaccaaagagctatatttcaaggacccttggttgggatcaatacccacatgggcggtggggtgattcccggaacccatcgtatggagcacttactgactaccagcagttcactcgaccacgtgggaggggtaagaagctccaagaggaatgggcggttccagtgaaatctgttgaagacattaacgagcgattcatgaacttctgtcaaggaaaacttacaagcagcccatggtctgagcttgatggccttcaacctgagacaaagataatagacgaccaattggtgaagattaaccagaagggcttccttaccattaacagccaacctgctgttaatggagagagatctgattcaacaagtgttgggatggggtggtcctggaggctatgtttaccagaaggcctatcttgagttcttctgttcaaaagagaagctggatcagctaattgagaagagcaaggcattcccttctcttacatacattgccgtgaacaaggacggagagtcattctcaaacattcccacaaacgctgtgaatgcggtcacatggggtgttttccctggcaaggaaatagtccagccaactgtcgttgactcagccagctttatggtttggaaagacgaagctttcgaaatttggtcaaagggttgggcttgcctgttccctgagggcgactcatctagggagatactagacaaggtccagaagagctacttcttggttagtcttgtggacaacgactacatcaacggtgatctcttcgcggcgttcaaggagatttga

SEQ ID NO: 124 - protein, 609 aa, Oryza sativa
  misc_feature (56)..(56): Xaa = any naturally occuring amino acid
  misc_feature (156)..(166): Xaa = any naturally occuring amino acid
  misc_feature (195)..(195): Xaa = any naturally occuring amino acid
  misc_feature (254)..(254): Xaa = any naturally occuring amino acid
MKVIEKIQEAAADGRTVFSFEYFPPKTEEGLDNLFERMDRMVAHGPNFCDITWGAXGSTADLTLEIANRMQNMVCVETMMHLTCTNMPVEKIDDALTTIKSNGIQNVLALRGDPPHGQDKFVQVAGGFACALDLVQHIRAKYGDYFGITVAGYPGXXXXXXXXXXXAHPDAIQSTEGATPEAYSNDLAYLKQKVXVDAGADLIITQLFYDTDIFLKFVNDCRQIGITCPIVPGIMPINNYKGFLRMTGFCKTKXIPAEITAALEPIKDNEEAVKAYGIHLGTEMCKKILATGIKTLHLYTLNMEKSALGILMNLGLIEESKISRSLPWRPPTNVFRVKEDVRPIFWANRPKSYISRTLGWDQYPHGRWGDSRNPSYGALTDYQQFTRPRGRGKKLQEEWAVPVKSVEDINERFMNFCQGKLTSSPWSELDGLQPETKIIDDQLVKINQKGFLTINSQPAVNGERSDSTSVGWGGPGGYVYQKAYLEFFCSKEKLDQLIEKSKAFPSLTYIAVNKDGESFSNIPTNAVNAVTWGVFPGKEIVQPTVVDSASFMVWKDEAFEIWSKGWACLFPEGDSSREILDKVQKSYFLVSLVDNDYINGDLFAAFKEI

SEQ ID NO: 125 - DNA, 417 bp, Oryza sativa
atggccatggcgtcactaggagatagacgtaggcagcagtggcgagatgccaatgaggaggaggcaacatgcgtgggtgtgggaagtgggacggcaggtgctggggaggcgcaagtatggaacagcgtggcgaggacggcaagggcagtgtcgagggcagcggggaggattgatgaagcggtggaggaggacgacggcaacaccagcggtttggaaggggaaggggcagtgaggggaattggcggcgacgtggcattcatcggggctgcggtggcgctgcggagcttcgctggagggagaagcaatgcaacagtgttggaggtggttgcggccttgcgggggagagagcggagcggagatgcggagggagcgaccgagagagagggaggacgcgtgcgttgcgtggatcaggcctaa

SEQ ID NO: 126 - protein, 138 aa, Oryza sativa
MAMASLGDRRRQQWRDANEEEATCVGVGSGTAGAGEAQVWNSVARTARAVSRAAGRIDEAVEEDDGNTSGLEGEGAVRGIGGDVAFIGAAVALRSFAGGRSNATVLEVVAALRGRERSGDAEGATEREGGRVRCVDQA

SEQ ID NO: 127 - DNA, 1410 bp, Oryza sativa
atggcgtcctacgacaaggccatcgagtcatacaagaaggccatcacaaccgctgcatccgttgcagcgtctgtgatgctggtccgcagcgtcgtgaacgagctggttccatacgaggtgcgtgatgtgctgttttccggcctcggctacctgcgttcacaaatttcatctcagcacacaatcatcatcgaggagactgagggctggtcccacaaccacgtctacaacgcggtgcgggcttaccttgcaacacgcatcaacaacaacatgcagcgcctgcgagtcagcagcatggatgaatcttccgagaagatggttgtcaccatggaggaaggtgaagagctggttgatatgcatgagggaacagaattcaaatggtgcttaatctcacgtagcatttcagctgaccccaacaatggcaatggcagcggccaacgtgaggtccgctcctatgagctgagcttccacaggaagcacaaggagaaagccctgaaatcatacctcccattcatcattgctacagccaaggccataaaagaccaggaaagaattctccagatatacatgaatgaatactcagactcatggtctccaattgatctccaccacccatccacattcgacacgcttgccatggaccagaagctgaaacagtcaattattgacgaccttgataggttcatcaagagaaaagattactacaagaggattggcaaggcatggaagaggggttacctgctgtatggtccaccagggactggcaagtccagcttgattgcagccatggcgaatcatctcaagtttgacatatatgatcttgagctgactggggtccattccaactcggagctcagaaggcttctagtcggaatgaccagccggtccattcttgttgttgaggacattgactgtagcatcgaactgaaacaacgggaggcaggggagcaggtaacattatccgggctgctcaattttgttgatgggctgtggtcaacaagtggagaggaaaggatcatcgttttcacgaccaattacaaggagcgtcttgatcaagcacttatgcggcctggcaggatggacatgcacatccacatggggtactgcaccccagaggctttccggattcttgccagcaactaccactcgatcgactatcatgtcacatatccagagatcgaggagctgatcaaggaggtgatggtgacgcctgcggaggtcgctgaggctctcatgagaaatgatgatattgatgttgcactccttggtctactggagctcctaaagtcaaagataaaagatgccagcgagaccaaggctgaaagcaaggatgcaaataagcagacggaggagaataaagatagcaaagcgatggagaacaaaaatgactcctcaactgatgaatgcacttag

SEQ ID NO: 128 - protein, 469 aa, Oryza sativa
MASYDKAIESYKKAITTAASVAASVMLVRSVVNELVPYEVRDVLFSGLGYLRSQISSQHTIIIEETEGWSHNHVYNAVRAYLATRINNNMQRLRVSSMDESSEKMVVTMEEGEELVDMHEGTEFKWCLISRSISADPNNGNGSGQREVRSYELSFHRKHKEKALKSYLPFIIATAKAIKDQERILQIYMNEYSDSWSPIDLHHPSTFDTLAMDQKLKQSIIDDLDRFIKRKDYYKRIGKAWKRGYLLYGPPGTGKSSLIAAMANHLKFDIYDLELTGVHSNSELRRLLVGMTSRSILVVEDIDCSIELKQREAGEQVTLSGLLNFVDGLWSTSGEERIIVFTTNYKERLDQALMRPGRMDMHIHMGYCTPEAFRILASNYHSIDYHVTYPEIEELIKEVMVTPAEVAEALMRNDDIDVALLGLLELLKSKIKDASETKAESKDANKQTEENKDSKAMENKNDSSTDECT

SEQ ID NO: 129 - DNA, 395 bp, Oryza sativa
atggcgcgcggcgtggcggtggcggcgaagggcggcgcgggcggcaagaagaagggctccgtctcgttcgtgatcgactgctccaagcccgtggaggacaagatcatggagatcgcgtcgctggagaagttcctgcaggagcgcatcaaggtcgccggcggcaaggccgggaacctcggcgactccgtcaccgtcacgcgcgacaagaccaaggtcaccgtcacctccgacggggccttctccaagagaggtatctgaagtacttgaccaagaagtacttgaagaagcacaatgtgcgggactggctacgtgttattgcggctaacaaggaccgcaatgtctatgagctcagatacttcaacattgctgagaacgagggcgaggaggaagactag

SEQ ID NO: 130 - protein, 131 aa, Oryza sativa
  misc_feature (83)..(83): Xaa = any naturally occuring amino acid
MARGVAVAAKGGAGGKKKGSVSFVIDCSKPVEDKIMEIASLEKFLQERIKVAGGKAGNLGDSVTVTRDKTKVTVTSDGAFSKXRYLKYLTKKYLKKHNVRDWLRVIAANKDRNVYELRYFNIAENEGEEED

SEQ ID NO: 131 - DNA, 367 bp, Oryza sativa
atgtcgtcgatgctgtccgcgttctcgcagtggttcgtgaacccgcgccgcaacccgctcgcccgcctccacatgcaggcgatctcctcgcgcctccggaaatacgggcctgaggtacgacgatctgtacgacccgaagcatgatctggacatcaaggaggcgctcgagaggcttcccagggaggtggtcgacgcccgccaccagcgcctcaagcgcgccatggacctctccatgaagcaccagtacctctccgaaaacgaccagcaggcgcaacagacaccattcagaggctatttgagtgacatgatggatctggagcgtgaagaactgggagcccttccccttcaccagaggacccttccctga

SEQ ID NO: 132 - protein, 121 aa, Oryza sativa
MSSMLSAFSQWFVNPRRNPLARLHMQAISSRLRNTGLRYDDLYDPKHDLDIKEALERLPREVVDARHQRLKRAMDLSMKHQYLSENDQQAQQTPFRGYLSDMMDLEREELGALPLHQRTLP

SEQ ID NO: 133 - DNA, 882 bp, Oryza sativa
atggcggcggaggccggaggccgcggcgctgccgcagctgcagctgcagcttctctcgctcgtctccgagcaccggctcctccgcgtgagctttgcttgccgatcatccaatgccttgagcgggagcgtgcggcgcgcgaggagctccacgccgccagccaaagatggaaggaggcggaggaggggcaccgtcgggagacgcgggagctgcgtgcggaggtggcggcgagggacgacgcgctccgtcggctcgagtccagggactctgcttgttctctgcaatggactatccagatgaaggataaacagattgctgtgatttcagaaaagctgaatgctcatctggctttatttagttcagtaggaaaggaagtcgctgcggtgaaacaagtactcggtaatgtgaaatgtctagttggcgacaaggaaaatgtagtttctgacttgaagggtaaagtagagaagatttctgtgcttgagaaagattttgttgagaagcaggcaatgcttatggagcttcacaacatggagattgctttacataaatttcaagacatatttgacagtattgggcatgagcattctgctttgccgtctccagagccagcaaatgcaaatgccgaaacagctgactgcctacatggatccgaagatattgacatggataattcatctccaggacgcatggatacccaggtcaaacttgccgtcgtggtgaaggtgatgggccgcaccggctccaggggtcaggtgacccaggtcagagtgaagttcctcgacgaccagaaccgtctcatcatgaggaacgtcaagggcccggtccgtgagggcgacatcctcaccctgctcgagtctgagagggaggccaggaggctgcgctga

SEQ ID NO: 134 - protein, 293 aa, Oryza sativa
MAAEAGGRGAAAAAAAASLARLRAPAPPRELCLPIIQCLERERAAREELHAASQRWKEAEEGHRRETRELRAEVAARDDALRRLESRDSACSLQWTIQMKDKQIAVISEKLNAHLALFSSVGKEVAAVKQVLGNVKCLVGDKENVVSDLKGKVEKISVLEKDFVEKQAMLMELHNMEIALHKFQDIFDSIGHEHSALPSPEPANANAETADCLHGSEDIDMDNSSPGRMDTQVKLAVVVKVMGRTGSRGQVTQVRVKFLDDQNRLIMRNVKGPVREGDILTLLESEREARRLR

SEQ ID NO: 135 - DNA, 486 bp, Oryza sativa
atggaggcagcgtattcggcgccgagcacgtcgtcgacctactcgttccacttctccatggcgcaggccgtgctcaccatctccctcaacgtcatcgccatcggcctctccgccctcgtcaaatcctcctcctcctcctcatcgagttcgtcttcccggcgccgcgccgctgcagcgcccgcggtggcgccgccggcggcggttgacctggacacggttcttggcctgatgggcggcgcgggcggcgccgcgccgtcggaggaggccaccctgggggaggccgcggcggcgttccgcgtcttcgaccgcaacggcgacggcttcatcgacgccggcgagctcgggagcgtgctcgcctcgctcgggttcgccgccggcgccggccacgccgagtgccagcgcatgatcgacgcctacgacgcggacaaggacggcagggtcgatttccgcgagttcctcaagttcatggagacggctgcggcctag

SEQ ID NO: 136 - protein, 161 aa, Oryza sativa
MEAAYSAPSTSSTYSFHFSMAQAVLTISLNVIAIGLSALVKSSSSSSSSSSSRRRAAAAPAVAPPAAVDLDTVLGLMGGAGGAAPSEEATLGEAAAAFRVFDRNGDGFIDAGELGSVLASLGFAAGAGHAECQRMIDAYDADKDGRVDFREFLKFMETAAA

SEQ ID NO: 137 - DNA, 306 bp, Oryza sativa
atgccttctacaccatcgtgccgtgccgtcttcatcgccacctcgtcactgacgacaccgaagaaagaggtgacgttgccaacacgacaagctctgtacagcctgccacctcggcgaggccgaccgggaggcctcgacaccaccgtgctcatctgcagccgtgacgatagcaacaacaattacggcaaggccacagaggatagcagcaacggctgcgacgagagcatgaagaaggacatccgcacgcatctacgtccaaggcacacacacaagccgccatatatccagcaacgaatgccgcgttag

SEQ ID NO: 138 - protein, 101 aa, Oryza sativa
MPSTPSCRAVFIATSSLTTPKKEVTLPTRQALYSLPPRRGRPGGLDTTVLICSRDDSNNNYGKATEDSSNGCDESMKKDIRTHLRPRHTHKPPYIQQRMPR

SEQ ID NO: 139 - DNA, 477 bp, Oryza sativa
  misc_feature (409)..(409): y = cytosine or thymine
atggtgctaaagtggcggcggcacatcgtgtatagtggaagcacggcgtgcggtgcgtggccgccgcgcggcctcgccaaggaccggcagcgaatggggaagagcagcagcaagaagaagaaggacaaggtgatcctgcccccgcagctgccgccggaggtggacgacgacgacgtggtggtctctgacgaggacgtcgagttcttcaggggcaacgagggccacgcccgcgcgctcgccacgctcgacaggaagtccatcgacagctacgtcaccagggtcgcccaccacgacgaggacgaggtcgagcgcctctacgaggagcgcgagcgcaggaggaaggcggtcgaggccctcaggcccaagaaccacgacgacgacgacttcgaggtcgaccgcgtcgacgccytccccgtcaagaccctgcaaggggagctggtctacaacaacgttgcagtactgaggagaaaatgttga

SEQ ID NO: 140 - protein, 157 aa, Oryza sativa
MVLKWRRHIVYSGSTACGAWPPRGLAKDRQRMGKSSSKKKKDKVILPPQLPPEVDDDDVVVSDEDVEFFRGNEGHARALATLDRKSIDSYVTRVAHHDEDEVERLYEERERRRKAVEALRPKNHDDDDFEVDRVDAPVKTLQGELVYNNVAVLRRKC

SEQ ID NO: 141 - DNA, 459 bp, Oryza sativa
atggccatggcgatgagaagggtggtgctggtggcggcggtgctgtgcgcggtggtcgccatggtcacagcgcaggaggcatccaacgtgcgcgccacgtatcactactatcgccccgcgcagaacaactgggacttaggagccccagccgtgagcgcgtattgtgctacgtgggacgctaacaagccactgtcgtggcgtcagaagtatggctggactgccttttgcgggcccgttggtcctaggggtcaggctgcatgtggcaagtgccttctgttgcaggtgacgaacacggcgacgggggcgcagatcacggcgaggatcgtggaccagtgcgccaatggcggccttgacctggactgggacaccgtcttcaccaagatcgacaccgacggccagggctaccagaagggccacctcatcgtcaactacaagttcgtcgactgcggcgacaactga

SEQ ID NO: 142 - protein, 152 aa, Oryza sativa
MAMAMRRVVLVAAVLCAVVAMVTAQEASNVRATYHYYRPAQNNWDLGAPAVSAYCATWDANKPLSWRQKYGWTAFCGPVGPRGQAACGKCLLLQVTNTATGAQITARIVDQCANGGLDLDWDTVFTKIDTDGQGYQKGHLIVNYKFVDCGDN

SEQ ID NO: 143 - DNA, 522 bp, Oryza sativa
atggtggtggcggtgctgtgtgcggtagcaactatggccatggcacaagaggcgtccaacgtgcgtgccacgtaccactactaccgtccggcggaaaacaattgggatttgggggccccggccgttagcgcgtactgtgccacgtgggatgctgacaagccgcttgaatggcgccagaagtatggatggaccgccttctgtgggcccgttggtcccactggtcaggatgcatgtggcaaatgtctctcgttgcaggtgacgaacacggcgacaggggatcagatcacggcgaggatcgtggaccagtgcgccaatggggggctggatttagactgggacaccgtcttctccaagatcgacagcgacggtcaaggctaccagaatggccacctcatcgtcgactaccagttcgtcgactgcggcgataactagcagctaattaaccactcttataaacttccctacatatatatacacatttcggacagaggagtaattaatatatctctgcctgatgaatga

SEQ ID NO: 144 - protein, 143 aa, Oryza sativa
MVVAVLCAVATMAMAQEASNVRATYHYYRPAENNWDLGAPAVSAYCATWDADKPLEWRQKYGWTAFCGPVGPTGQDACGKCLSLQVTNTATGDQITARIVDQCANGGLDLDWDTVFSKIDSDGQGYQNGHLIVDYQFVDCGDN

SEQ ID NO: 145 - DNA, 441 bp, Oryza sativa
atggcggggatcaccggatctcgagcactcatggtggtggcgctcctctgcgctgccgcggccatgactgctgcacaagaagcatccaacgtgcgagccacgtatcattattacaacccacaacagaacaactgggacctgaacaaagtgagcgcatattgtgccacatgggatgccaacaaaccgttgtcttggcgccagaagtatggatggaccgccttctgtggacctgctggtcctaggggccgagactcgtgtggcaagtgtatccaggtgaagaaccggggaacaggtgcgacaataattgcgaggattgttgaccaatgcagcaatggtgggttggatctggactacgagaccatcttcaagaagatcgacacagatggtcgtggctaccagatgggtcacctccaggtcgattacaagttcgtcaattgttga

SEQ ID NO: 146 - protein, 146 aa, Oryza sativa
MAGITGSRALMVVALLCAAAAMTAAQEASNVRATYHYYNPQQNNWDLNKVSAYCATWDANKPLSWRQKYGWTAFCGPAGPRGRDSCGKCIQVKNRGTGATIIARIVDQCSNGGLDLDYETIFKKIDTDGRGYQMGHLQVDYKFVNC

SEQ ID NO: 147 - DNA, 420 bp, Oryza sativa
atgcatgtggcggcggcccaacaagcattcggcgtgagagccacctaccacttttacaggccagcagccaacggctgggatctgacggccacgggtgccttctgctccacgtgggatgctgggaagccgttcgattggcgcagcaagtatgagtggacggccttctgtgggcccgttgggcccaccggcagggactcctgcggcaagtgtcttcggcaggtgacgaatagggtgacgggagcccagaccacggcgaggattgtggacaagtgcgccaacggaggactagatctggactgggacactgtcttctccaagatcgacactgacggccagggcttccagcgcgggcacctcaccgtcgactatagcttcgttaactgcggcgacaacaattatctcgctgaggttgtcatttaa

SEQ ID NO: 148 - protein, 141 aa, Oryza sativa
  misc_feature (33)..(34): Xaa = any naturally occuring amino acid
MHVAAAQQAFGVRATYHFYRPAANGWDLTATGXXAFCSTWDAGKPFDWRSKYEWTAFCGPVGPTGRDSCGKCLRQVTNRVTGAQTTARIVDKCANGGLDLDWDTVFSKIDTDGQGFQRGHLTVDYSFVNCGDNNYLAEVVI

SEQ ID NO: 149 - DNA, 1584 bp, Oryza sativa
  misc_feature (37)..(37): m = adenine or cytosine
  misc_feature (65)..(65): s = guanine or cytosine
  misc_feature (76)..(76): s = guanine or cytosine
atgtcgctcgaaatccatgaaggttacggggcggcamaagacaccgacctgcacgtggcggcccscggaggggacsccggggcgctgcgccgcgcgctggacgaggcggcggcggccgtggccaccggggaggggagggaggcgctggaggaggtgcggcgggccgtggcggcggagcccaacgaggccggggagacgccgctcgtcgccgcggcggagagggggcacctggaggtggtaagggagctgctcaggcacctcgacgccgagggggtcgccgcgaagaacaggtcggggtacgacgcgctgcacgtcgcggcgagagaaggccgtcatgctgttgtgcaggaaatgttacttcacaataggttgcttgccaagacctttgggcctgcgaatactagtccacttatttcagcagctacgaggggtcacaccgaagttgtcaaattgttactagaactagatgattttggattggtggaaatggctaaagataatgggaaaaattccttgcattttgctgctcgacaagggcacgttgaaattgttaaagcattactcgagaaagatcctcagctagcaagaagaaatgacaagaaaggtcaaacagccttgcatatggctgtaaaaggaacaaactgtgatgtgcttagagcacttgtcgacgctgatccagcaattgtaatgctgccagacaaaaatggaaacaccgccttgcatgtagcaacaaggaaaaagcgagcagagatagttgctgttctcttgcgattaccagatacccatgtcaatgcactaaccagagaccacaagactgcgtatgatatagctgaagccttgccactctgtgaggagtcttctgaaataaaggatattttatctcagcatggcgcactcagatctagggagctgaatcagcctcgagatgagctccgaaaaacagtgacagagatcaagaaagatgtccacacacagctggaacagacaagaaaaacgaacaaaaatgtgcatgggattgctaaggaactcagaaagttgcacagagaaggcatcaataatgcaacgaactctgtaactgttgttgcagtactttttgccacggtagcctttgcagccatattcactgtgcctggtggaaatgccaacaatggagttgcggttgttgttcaggcagcctcctttagaattttcttcatcttcaatgctatagctctgtttacatcattggcggtggtcgtagttcagataacggttgtcaggggagaaactaagtctgagaggaaggttgttgaggtgatcaacaagcttatgtggctggcatcagtttgcactaccatttctttcattgcctcttgctatattgtgctaggccgccatttccaatgggcagcactactagttagtttgataggtggcatcacaatggctggtgttctgggtacaatgacatactatgtggtgaaatcaaagcgcatgaggaagataagaaaaaaagagaagatgtcaagaagaagtggatctagctcctggtatgataatactgagctctcagagactgagcttaaccaagtgtatgccttgtaa

SEQ ID NO: 150 - protein, 527 aa, Oryza sativa
MSLEIHEGYGAAEDTDLHVAARGGDAGALRRALDEAAAAVATGEGREALEEVRRAVAAEPNEAGETPLVAAAERGHLEVVRELLRHLDAEGVAAKNRSGYDALHVAAREGRHAVVQEMLLHNRLLAKTFGPANTSPLISAATRGHTEVVKLLLELDDFGLVEMAKDNGKNSLHFAARQGHVEIVKALLEKDPQLARRNDKKGQTALHMAVKGTNCDVLRALVDADPAIVMLPDKNGNTALHVATRKKRAEIVAVLLRLPDTHVNALTRDHKTAYDIAEALPLCEESSEIKDILSQHGALRSRELNQPRDELRKTVTEIKKDVHTQLEQTRKTNKNVHGIAKELRKLHREGINNATNSVTVVAVLFATVAFAAIFTVPGGNANNGVAVVVQAASFRIFFIFNAIALFTSLAVVVVQITVVRGETKSERKVVEVINKLMWLASVCTTISFIASCYIVLGRHFQWAALLVSLIGGITMAGVLGTMTYYVVKSKRMRKIRKKEKMSRRSGSSSWYDNTELSETELNQVYAL

SEQ ID NO: 151 - DNA, 1055 bp, Oryza sativa
  misc_feature (288)..(288): r = adenine or guanine
  misc_feature (294)..(294): s = guanine or cytosine
atgaagctcgccgtggtggccgcgctcatctcggccgccgccgtgggcgcccgcgcctgcctcgacgtcggcttctacgacacgacgtgcccgacggcggagacgctcatacagcaggtcgtcgccgccgccttccgcaacgactccggcgtcgcgccggccatgatccgcatgcatttccacgactgcttcgtcaggcgtgcagggctgcgacggctcggtgctgatcgacaccgtgccggggtcgacgacgagggcggagaaggacgccgcgccaaacaacccggrgcttcsggttcttcgacgtgatcgaccgcgccaagtcggccgtcgaggcggcgtgcccgggcgtcgtctcctgcgccgacgtcgtcgccttcatggcgcgggacggcgtcgtgctgtccggcggcctcggctaccaggtgcccgcggggcggcgcgacggccggacctccctcgaggacgacgcgctcaacttcctgccgccgccaacgtccaccgccgccgacctcgtcgccaacttcaccgccaagaacctcaccgccgaggacatggtcgtcctctccggcgcccacaccatcggcgtctcccactgcgactccttcaccaatcgcatctacaacttcattgatccgtcgttgagcaaggcgtacgcgttcttgctgaagggcatctgtccgccgaacagcaaccagacgttcccgacgacgaccaccttcatggacatcctgacgccgaccaagttcgacaacaggtactacgtcgggctgacaaacaacctcggcctcttccagtcggacgcggcgctgctgacggacgccgcgctcaaggccacggtgaactccttcgtgcgcagcgaggcgacgttccggctcaagttcgccagggccatgatcaagatggggcagatcggcgtgctgtccgggacgcagggcgagatcaggctcaactgcagggtcgtcaaccctgtcaatgtcactgctactgcagctgatgatcaccaccttacttcctcttcctcctcttcttcagatgaagtggctgcaagctaa

SEQ ID NO: 152 - protein, 350 aa, Oryza sativa
  misc_feature (96)..(96): Xaa = any naturally occuring amino acid
  misc_feature (98)..(98): Xaa = any naturally occuring amino acid
MKLAVVAALISAAAVGARACLDVGFYDTTCPTAETLIQQVVAAAFRNDSGVAPAMIRMHFHDCFVRRAGCDGSVLIDTVPGSTTRAEKDAAPNNPXFXFFDVIDRAKSAVEAACPGVVSCADVVAFMARDGVVLSGGLGYQVPAGRRDGRTSLEDDALNFLPPPTSTAADLVANFTAKNLTAEDMVVLSGAHTIGVSHCDSFTNRIYNFIDPSLSKAYAFLLKGICPPNSNQTFPTTTTFMDILTPTKFDNRYYVGLTNNLGLFQSDAALLTDAALKATVNSFVRSEATFRLKFARAMIKMGQIGVLSGTQGEIRLNCRVVNPVNVTATAADDHHLTSSSSSSSDEVAAS

SEQ ID NO: 153 - DNA, 1737 bp, Oryza sativa
  misc_feature (375)..(375): k = guanine or thymine
atggcgaacgccggtgtcaatgagacggtcgccgtcgccgtcgccattgacgcacctggagttgggcatgaccatggtgccgccggcgaggttcgtcgtccgtcgacgcgccggctggctccggcgggaagcggcgggcggctgatggcggagcttcttggcgtgttcaatggactgacggagcggatgggggaggacgtggcgacctcgtcgtcgtcgcggcttctcttccgcgcgctcaagctggcgcttcccgcgctccgcgacggcggctgcgattgcggcggcggccagtccgtctcccgtgcgctcgtggtcgccgcctccctcgccgacctccagatggacgcggaggtcatctcggctggcatggtkaggggagctctggataccggggcactcgccatggccgacgtcgaggcgcagctcggtgccagcgccgccggtctggtggaagagagcctcaaggtgaagcgcgcgccgtcggaggtcgacgtcgccgacgaggaggccgcgagcgcgctgcggaagcggtgcctctccagctacgacatccgcgccgtcatcctggagctcgccgtcaagctcgacgccatgaagcacctcgacgtcctccccaagcaccagcagcggaccacctcgcttgaggtgctcaaggtgttcgcgctgctggcgcacgccgtcggcgccggcgagctgtcgctggagctcgaggacctctccttccagcgcctgtacccgcaggcctacgcccacatcgaccagtggctgagcagccaagaagacgactgcaagcgcgtcatcgccgcgtccaaggaggagctcctccgcgcgctcaccgccgacgacgagctccgctgcaccgtcaccggcgtcgacgtcatgggccggtacaagagccggttcagcaccatgaagaagctggtgaaggacggccggcggccggaggacgtgaacgacatcctcggcatgcgcgtcatcctggaccctcgccccggcggcggcggctgcgccgacggcgacggcggcgacagggcatgcctgcggacgcacgaggtgatcaaggccatgtggaaggacgtgccggcgaggaccaaggactacatcacgcgtcccaaggggaacgggtaccggagcttgcacgtcgccgtcgacatgagcgagccggggccggaggggaagaagaggccgctgatggagatccaggtgcgcaccagggagatggacatggccgccgtcggcggccaggcgtcgcacgcgctctacaagggcggcctcaccgatcctgaggaggccaagaggctcaaggccatcatgctggcggcggcggaggtggcagctcagcacctccgcgacgagccagccggcgacggtggtcaaacaaccgccgccgcctccgccgccaccgccggcaatgtcgagcgagcgttccagctgctcgacaagaacggcgacgggaggatcagcatggaggagctaaccgagatcatggaggacctcggcgccggcggccatgacgccgaggagctcatgcgcctcctcgacgccaacagcgacggctcgctcagctccgacgagttcgcgctcttccagaaacgggttaagctgaagacgaagttagagaacaaggatgatgagtacaaggagatcctcaagcagaagctgcagaaggttgacgacacggggctcatccacgtctaccgcaagaacctcagcgacaagttggtcctcgtttga

SEQ ID NO: 154 - protein, 578 aa, Oryza sativa
MANAGVNETVAVAVAIDAPGVGHDHGAAGEVRRPSTRRLAPAGSGGRLMAELLGVFNGLTERMGEDVATSSSSRLLFRALKLALPALRDGGCDCGGGQSVSRALVVAASLADLQMDAEVISAGMVRGALDTGALAMADVEAQLGASAAGLVEESLKVKRAPSEVDVADEEAASALRKRCLSSYDIRAVILELAVKLDAMKHLDVLPKHQQRTTSLEVLKVFALLAHAVGAGELSLELEDLSFQRLYPQAYAHIDQWLSSQEDDCKRVIAASKEELLRALTADDELRCTVTGVDVMGRYKSRFSTMKKLVKDGRRPEDVNDILGMRVILDPRPGGGGCADGDGGDRACLRTHEVIKAMWKDVPARTKDYITRPKGNGYRSLHVAVDMSEPGPEGKKRPLMEIQVRTREMDMAAVGGQASHALYKGGLTDPEEAKRLKAIMLAAAEVAAQHLRDEPAGDGGQTTAAASAATAGNVERAFQLLDKNGDGRISMEELTEIMEDLGAGGHDAEELMRLLDANSDGSLSSDEFALFQKRVKLKTKLENKDDEYKEILKQKLQKVDDTGLIHVYRKNLSDKLVLV

SEQ ID NO: 155 - DNA, 810 bp, Oryza sativa
  misc_feature (251)..(251): s = guanine or cytosine
  misc_feature (257)..(257): s = guanine or cytosine
atgtcgagcgcgtcgtccatggaagcgctccacgccgcggtgctcaaggaggagcagcagcagcacgaggtggaggaggcgacggtcgtgacgagcagcagcgccacgagcggggaggagggcggacacctgccgcaggggtgggcgaagcggaagcggtcgcgccgccagcgatcggaggaggagaacctcgcgctctgcctcctcatgctcgcccgcggcggccaccaccgcgtccaggcgccgcctcsgctctsggcttcggcgcccccgccggcaggtgcggagttcaagtgctccgtctgcggcaagtccttcagctcctaccaggcgctcggcggccacaagacgagccaccgggtcaagctgccgactccgcccgcagttcccgtcttggctccggcccccgtcgccgccttgctgccttccgccgaggaccgcgagccagccacgtcatccaccgccgcgtcctccgacggcatgaccaacagagtccacaggtgttccatctgccagaaggagttccccaccgggcaggcgctcggcgggcacaagaggaagcactacgacggtggcgtaggcgccggcgccggcgcatcttcaaccgagctcctggccacggtggccgccgagtccgaggtgggaagctccggcaacggccagtccgccacccgggcgttcgacctcaacctcccggccgtgccggagttcgtgtggcggccgtgctccaagggcaagaagatgtgggacgaggaggaggaggtccagagccccctcgccttcaagaagccccggcttctcaccgcgtaa

SEQ ID NO: 156 - protein, 269 aa, Oryza sativa
MSSASSMEALHAAVLKEEQQQHEVEEATVVTSSSATSGEEGGHLPQGWAKRKRSRRQRSEEENLALCLLMLARGGHHRVQAPPPLSASAPPPAGAEFKCSVCGKSFSSYQALGGHKTSHRVKLPTPPAVPVLAPAPVAALLPSAEDREPATSSTAASSDGMTNRVHRCSICQKEFPTGQALGGHKRKHYDGGVGAGAGASSTELLATVAAESEVGSSGNGQSATRAFDLNLPAVPEFVWRPCSKGKKMWDEEEEVQSPLAFKKPRLLTA

SEQ ID NO: 157 - DNA, 114 bp, Oryza sativa
atggtgcgctgtgtggattatgttgtgcgaggggtattgtcacagtcccgtttcgaggtagatggatcggcaatggatgtacaccgcggaacgacggtcgacaaagtttattga

SEQ ID NO: 158 - protein, 37 aa, Oryza sativa
MVRCVDYVVRGVLSQSRFEVDGSAMDVHRGTTVDKVY

SEQ ID NO: 159 - DNA, 165 bp, Oryza sativa
atggctcaccggctgcgtgccttcctcgccggtgaggtgggtgagctcaagcttaacggggctcgcttggccaccactgcttctacatgggcagaactggagctcaagttagacggagctcaccgtccaccgtgcctttccgcggatggcctcgccaaccgctga

SEQ ID NO: 160 - protein, 54 aa, Oryza sativa
MAHRLRAFLAGEVGELKLNGARLATTASTWAELELKLDGAHRPPCLSADGLANR

SEQ ID NO: 161 - DNA, 2565 bp, Oryza sativa
  misc_feature (501)..(501): r = adenine or guanine
atggattggccagcttcagcttccacttgcatcgccatccttctcttcgttttcttgatttcatggccgtcactgtgcgcctccgacgaccggcttgccatcggcaagacgctgtctcccggcgcaaccctcgtctccgacggcggcgccttcgccatgggcttcttctcgccgtcgtccaactccactaatgctacctcgtcgggactttacctcggaatatggtacaacaacatccccaagctcaccgtcgtgtgggtcgccgaccaggcggcgcccatcgccgaccatccttcctccccggcctccacgctagccgttgccagcgacggcaacctggtcttgtccgatggcgccaccggccgcgtcctttggaggactaacgtcaccgccggcgtgaactcgtcggcgtcatcgggaggaggagtcggtgctgtggcggtgctcgccaactccggcaacctcgtgctccggctgccggacggcaccgccttgtgggaracgttcgagaaccccggcaacgcgttcctgcccggcatgaagatcggcgtcacctaccggacgcgcggcggcgtgcgactggtctcatggaagggcgccaccgacccgtcgccggggaacttctccttcggcggcgacccggaccggccgctgcaggtggtcatctggaaaggctcgcgcgtttactggcgctccaacccatggaagggctacatggtggtggacagcaactaccagaagggcggcaggtcggcgatctacaccgccgtcgtctccaccgacgaggagatctacgccgcgttcacactgtccgacggcgcgccgccgatgcagtacacgctgggctacgccggcgacctccgcctgcagagctggagcaccgagacgtcgtcgtgggccacgctcgccgagtaccccacccgcgcgtgcagcgcgttcggctcatgcggcccgttcggctactgcggcgacgtcacggccaccgcctcgacgtgctactgcctcccggggttcgagccggcgagcgccgccggctggagccgcggcgacttcacgctggggtgccggcggagggaggcggtgcggtgcggcgacgggttcgtggcggtggcgaacctgaagctgcccgactggtacctgcacgtgggcaaccggagctacgaggagtgcgcggcggagtgccgccggaactgctcctgcgtggcgtacgcctacgccaacctcaccgggagctccacgagggatgcgacgaggtgtttggtttggggcggcgacttggtggacatggagaaggtggtcgggacatggggtgacttcggtgagacgctctacctccggcttgcaggtgcaggtaggaagccaaggactagtgcactgagatttgcacttccaatagttttagcaagtgttcttatacccatatgcattttaatatgtgctcccaagatcaaagaaattatcaagaaaaaatatggggagaataacaagaggcgggccttgcgagttttgagcatttctgatgatcttgggcaggaaatcccagccaaagatcttgagtttccatttgttgaatatgacaagatcctagttgcaacagacaacttttctgaagcatctttgattggaaaaggaggttttggcaaagtttacaagggagtgttagatggccgggaagttgcagtcaaaagacttagcagttggtctgaacaaggaatagtggagttcagaaatgaggtggtcctaattgccaaactacagcacagaaaccttgttcgacttgtcggttgcagcatcgaaggagatgaaaagttgctgatttatgagtatatgcccaacaagagcttagatgcttctcttttcaagggtaaaagaaaatcagtgttggactggtccacacggttcaagatcgtcaaaggggttgcccgaggacttctttacctccatcaagattcaagattaacaattatccatagagatcttaaggcaagcaacattttgttggatgcagagatgaacccaaagatatcggattttggtatggcaaggattttcggcaacaaccagcaaaaggaagtcactaaacgagttgttggaacatatggctatatggctcctgaatatgctatgggaggtatcttttcaatgaagtccgatgtctacagcttcggcgttttacttctagagatagtaagcggttctaagataagctctattgatctcattgaggactccccaaatcttccagtctatgcatggaatctatggaatgaagggaaggcagacattatgatagactcaactatcactgcaaactgcttattggatgaagtcattctctgcatccatgtggccctcctgtgtgttcaggagaatctcaatgacaggccactcatgtcagatgttgtgctcatcttggagaaaggaagcaagtcactcccagctccaaatagaccggcttattttgcacaaaggaacaacaatgaagtagagcaagtaagaaatggtagccagggcgctcagaattctaacaacaacatgactctcacagatctagagggacgatga

SEQ ID NO: 162 - protein, 854 aa, Oryza sativa
MDWPASASTCIAILLFVFLISWPSLCASDDRLAIGKTLSPGATLVSDGGAFAMGFFSPSSNSTNATSSGLYLGIWYNNIPKLTVVWVADQAAPIADHPSSPASTLAVASDGNLVLSDGATGRVLWRTNVTAGVNSSASSGGGVGAVAVLANSGNLVLRLPDGTALWDTFENPGNAFLPGMKIGVTYRTRGGVRLVSWKGATDPSPGNFSFGGDPDRPLQVVIWKGSRVYWRSNPWKGYMVVDSNYQKGGRSAIYTAVVSTDEEIYAAFTLSDGAPPMQYTLGYAGDLRLQSWSTETSSWATLAEYPTRACSAFGSCGPFGYCGDVTATASTCYCLPGFEPASAAGWSRGDFTLGCRRREAVRCGDGFVAVANLKLPDWYLHVGNRSYEECAAECRRNCSCVAYAYANLTGSSTRDATRCLVWGGDLVDMEKVVGTWGDFGETLYLRLAGAGRKPRTSALRFALPIVLASVLIPICILICAPKIKEIIKKKYGENNKRRALRVLSISDDLGQEIPAKDLEFPFVEYDKILVATDNFSEASLIGKGGFGKVYKGVLDGREVAVKRLSSWSEQGIVEFRNEVVLIAKLQHRNLVRLVGCSIEGDEKLLIYEYMPNKSLDASLFKGKRKSVLDWSTRFKIVKGVARGLLYLHQDSRLTIIHRDLKASNILLDAEMNPKISDFGMARIFGNNQQKEVTKRVVGTYGYMAPEYAMGGIFSMKSDVYSFGVLLLEIVSGSKISSIDLIEDSPNLPVYAWNLWNEGKADIMIDSTITANCLLDEVILCIHVALLCVQENLNDRPLMSDVVLILEKGSKSLPAPNRPAYFAQRNNNEVEQVRNGSQGAQNSNNNMTLTDLEGR

SEQ ID NO: 163 - DNA, 568 bp, Oryza sativa
atgcatcccatttctgatctacgcttctccggcgtattgcctattcgaaggtctcgtttgctcaccgggaatgcgtgccgccgccgccgctgtttgtgcttggtgcagtccgggaggaagaagacgcgagagcccaaggaggagaacgtgacgctcggccccacggtccgcgagggcgagtacgtcttcggcgtcgcgcacatcttcgcgtcgttcaacgacaccttcatccacgtgacggatctgtccggcagggagacgctcgtccgcatcaccgcaggtggcatgaaggtgaaagctgaccgtgatgagtcatccccttatgctgccatgcttgcatcccaggatgttgcacagagatgcaagaggagcttggaattactgctctgcacattaagctccgtgctactggtggaaacaagacaaaaactcctggtcctggtgctcaatctgcgcttagagctcttgcacgttctggcatgaagattggacgcattgagaggatgttactccagtcccaactgacagtacccgcagaaagggtggcagaagaggaaggaggctgtaa

SEQ ID NO: 164 - protein, 188 aa, Oryza sativa
MHPISDLRFSGVLPIRRSRLLTGNACRRRRCLCLVQSGRKKTREPKEENVTLGPTVREGEYVFGVAHIFASFNDTFIHVTDLSGRETLVRITAGGMKVKADRDESSPYAAMLASQDVAQRCKELGITALHIKLRATGGNKTKTPGPGAQSALRALARSGMKIGRIEEDVTPVPTDSTRRKGGRRGRRL

SEQ ID NO: 165 - DNA, 1926 bp, Oryza sativa
atggcatacaattacccatcagaaaaaataagtgtgtacctttccgatgatggaggttcaattcttactttctatgctttatgggaggcctccatatttgcaaagaaatggctaccattctgcaaaagatataacattgagccaaggtcaccagctgcttacttctcagagtcaaaagtgcatcacaatctgtgcatcccaaaagaatgggcactgatcaagaacctgtatgaagaaatgagagagagaattgatacagctaccatgtcaggaaaaattcctgaagaaatgaagctaaagcataaaggatttgatgaatggaactcagattttactttgaaaaatcaccagccaattgttcagattctgatagatgggaaaaaccgaaatgcaattgatgatgatagaaatgtgctaccaacaatggtatacgtggcgcgcgagaagaggcctcagtaccaccataacttcaaagctggggcattgaacgctttgataagggtatcatcagtgataagtgacagccctgttatcttgaacgtggactgtgatatgtattccaacaatagtgattcaatcagagatgcgttatgcttcttcctcgatgaagaaatgggccagaaaattggatttgtgcagtaccctcagatcttcaacaatatgacccaaaatgatatatatggaaactctttcaatgttagctatcatgtggagatgtgtggtttagacagtgttggtggttgtctctacattggcacaggatgcttccacagaagagagatcctttgtggtaggatattcagcaaagactacaaggaaaactggaacagaggaataaaggaaagaggaaaagagaacataaatgagattgaggagaaggcaacatctttagtaacttgcacttatgagcataggacacagtggggtaatgacattggagtgaaatacggtttcccggcagaggatatcattactggattggcaatacattgcagaggatgggagtcagccttcataaatcctaaaagagcagcatttttgggtttagccccatcaacacttgcccagaatatactgcaacataagagatggagtgagggtaatctcacaatttttctttcgaagtactgctccttcttgtttggacatggaaaaatcaagttacaactacagatgggctactgcatatgtggattatgggcagccaactcactgcctacactctattatgttgtgattccatcactaggtcttgttaagggcacccccctattcccacagattatgagtccatgggctacacccttcatatatgtattttgtgtgaagaccctctacggtctttatgaggcattattatctggggatacattgaaaggatggtggaatggacaaaggatgtggatggtgaaaagcattacctcatatctatatggcttcattgacaccatccgaaaatgtgtaggaatgtcaaagatgtcatttgaagttacagcaaaggtaagcggtcacgatgaagcaaagaggtatgagcaagaaatcctagaatttgggtcatcgtctcctgaatatgtgatcatcgcaaccgtcgcattactgaacttcgtctgcctagttggagggttaagtcaaataatggcaggtgtctggaatatgccatggaatgtgtttttaccccaggccatcctctgtggaatgatagtaatcattaatatgccaatttatgaggcaatgttcctaagaaaggacaatgggagaataccaacagcagtcacactagcttcaattggctttgtaatgttggcattcctagtacccaatagtttgaggtccctaaaatgggatttgatgccttataaaacattgggtgtttctgatgatgatcatgaaaataaattgcattgccatttcatgaaattctcttga

SEQ ID NO: 166 - protein, 641 aa, Oryza sativa
MAYNYPSEKISVYLSDDGGSILTFYALWEASIFAKKWLPFCKRYNIEPRSPAAYFSESKVHHNLCIPKEWALIKNLYEEMRERIDTATMSGKIPEEMKLKHKGFDEWNSDFTLKNHQPIVQILIDGKNRNAIDDDRNVLPTMVYVAREKRPQYHHNFKAGALNALIRVSSVISDSPVILNVDCDMYSNNSDSIRDALCFFLDEEMGQKIGFVQYPQIFNNMTQNDIYGNSFNVSYHVEMCGLDSVGGCLYIGTGCFHRREILCGRIFSKDYKENWNRGIKERGKENINEIEEKATSLVTCTYEHRTQWGNDIGVKYGFPAEDIITGLAIHCRGWESAFINPKRAAFLGLAPSTLAQNILQHKRWSEGNLTIFLSKYCSFLFGHGKIKLQLQMGYCICGLWAANSLPTLYYVVIPSLGLVKGTPLFPQIMSPWATPFIYVFCVKTLYGLYEALLSGDTLKGWWNGQRMWMVKSITSYLYGFIDTIRKCVGMSKMSFEVTAKVSGHDEAKRYEQEILEFGSSSPEYVIIATVALLNFVCLVGGLSQIMAGVWNMPWNVFLPQAILCGMIVIINMPIYEAMFLRKDNGRIPTAVTLASIGFVMLAFLVPNSLRSLKWDLMPYKTLGVSDDDHENKLHCHFMKFS

SEQ ID NO: 167 - DNA, 1680 bp, Oryza sativa
  misc_feature (26)..(26): s = guanine or cytosine
  misc_feature (30)..(30): m = adenine or cytosine
atggcggacgccgacgcgagggcccsgccmaaatcggaccccggcgccacgccgatcggttcgatctccccttcctccgccgcccccgccgccggggaggacgaggtggaggtcgaggtggaggtggaggagcagctcgccggactcgccatcgccgatcagggggaggagctgctgcttcccaagcccaccggctgggaggatggccctgttgttgttgctggagatgaggtctccggtggtgagaagctgccgggtgaggtggcggcggcggtgggggtggagggtgctgcggcggattcgaggccgcggttcccgaggcgacccggggagccggactgcacctactacgtcaagttcgggagctgccgctttgggatgaagtgcaagttcaatcatccggcgaggaagaagaagagtagggtgaaaggtagtaacggtggtagtggcagcggcgggagcaacagcagcagtaacaaagcctcctcgcctgatgatgagcagcaggctccaaaagaggaatacggaagctatgttccagatatttcacctgaagttgattctttgggatttgctgacaaggggagtgcgtctaacttagaaaactttaagaaatattcttatgagattatcgatgtgaagaagggaagagtggagccaaaggaacttaaggtactgaaggttgccaaagagaaaaggaaggaatttatttcagaaggtagttcccaggaggaatgcaagtattattcaacacctggaggatgcaaatttggtaaagcttgtaaatacctccaccgtgatggaaaagaagggaaaacagacgctgaaaaggttgacctgaactttctcggtcttccacttcgtccaagtattagacatgttctaatatctacaggataccttgtcatttttattctgtatccaccattgggtgtgactgtgatcatggggaaaaggagtgtccctactacatgcgtactgggagctgcaagttacgccactaactgcaagtttcaccatcctgatccttctaatgttgcttctaaagatccacagttggagcatgagaatggggatgctccacagcaagatgttcaaggatcatcgtctcagccaaatgcttcaatttggcccgatcagagaacagtgaatgagcatcatgttccgtttatagctccatctccatcgtacagtgcagggatgcttcctcctcaaggaatgtatccacctcctgaatggaatgggtatcatcaggttccgttgaatccatattatcctcctggagtccctttccaacattttccagctgctcctataaatcatcctatgtacaaggcaccagaaatacctggacatcagcaggttccttccgaggaatacccagagagacctggccaacctgaatgtcagcattttgtgaagagtggtttttgcaaatttaggatgaagtgcaaatatcaccacccaaggtcaccggtgcctccagcaggagctcttagccctcttggcttgcctataaaacctgatcagcctgtgtgcacatactatggtcgctatggggtctgcaaatttgggccagcttgcgcatacaatcaccccttcaattttagccctgtacctgcagcgggacctcctctcctccctgctcaatacccaactccaggaaactacactctctga

SEQ ID NO: 168 - protein, 559 aa, Oryza sativa
MADADARAPPKSDPGATPIGSISPSSAAPAAGEDEVEVEVEVEEQLAGLAIADQGEELLLPKPTGWEDGPVVVAGDEVSGGEKLPGEVAAAVGVEGAAADSRPRFPRRPGEPDCTYYVKFGSCRFGMKCKFNHPARKKKSRVKGSNGGSGSGGSNSSSNKASSPDDEQQAPKEEYGSYVPDISPEVDSLGFADKGSASNLENFKKYSYEIIDVKKGRVEPKELKVLKVAKEKRKEFISEGSSQEECKYYSTPGGCKFGKACKYLHRDGKEGKTDAEKVDLNFLGLPLRPSIRHVLISTGYLVIFILYPPLGVTVIMGKRSVPTTCVLGAASYATNCKFHHPDPSNVASKDPQLEHENGDAPQQDVQGSSSQPNASIWPDQRTVNEHHVPFIAPSPSYSAGMLPPQGMYPPPEWNGYHQVPLNPYYPPGVPFQHFPAAPINHPMYKAPEIPGHQQVPSEEYPERPGQPECQHFVKSGFCKFRMKCKYHHPRSPVPPAGALSPLGLPIKPDQPVCTYYGRYGVCKFGPACAYNHPFNFSPVPAAGPPLLPAQYPTPGNYTL

SEQ ID NO: 169 - DNA, 2118 bp, Oryza sativa
  misc_feature (1657)..(1657): m = adenine or cytosine
  misc_feature (1659)..(1659): y = cytosine or thymine
atggcgtctcacattgttgggtacccccgcatgggccccaagagggagctcaagtttgccctggagtctttctgggatgggaagagcagcgctgaggatttggagaaggttgcgaccgacctcagggccagcatctggaagcaaatggctgacgctgggatcaagtacatccccagcaacaccttctcgtactatgatcaggttcttgacacggctgccatgcttggtgctgtcccagagcgctactcatggactggtggagagattgggttcagcacctacttctcgatggctaggggcaatgccactgtccctgccatggagatgaccaagtggtttgacaccaactacactttatcgtccctgaacttggtcccaacaccaagttctcctactcttcccacaaggctgtgaatgaatacaaggaggctaaggcgggcgttgacaccgtgccagtacttgttggaccagtttcatacttgttgctctccaaacctgccaagggtgtagagaagtcgttcgctcttctttcccttctgagcagcatccttcctgtctacaagaggttattgctgagttgaaggcagctggtgctacttggattcagtttgatgaacccacacttgttcttgaccttgactctcaccaattggctgcattctctgctgcatacacagaacttgagtcggcactttctggattgaatgtgcttattgagacatacttcgctgacattcctgctgaatcatacaaaccctcacatccctgaacagcgtgactgcttatggttttgaccttatccgtggagccaagactcttgaccttatcaagagtgctggtttcccctctggaaagtacctctttgccggtgttgtggatggacgcaacatctgggctgatgatctcgctgcatctctcactacccttgagtctcttgaggctattgttggaaagggacaagcttgtggtctcgacttcctgctcactcatgcacaccgctgtggatcttgtaaatgagaccaagctcgatagcgagattaagtcatggctcgcttttgctgcccaaaaggtggttgaggtgaatgcccttgctaaggcattggctggacagaaggatgaggcttactttgcagcaaacgctgctgctcaggcctccaggaggtcatcacctcgtgtgacaaacgaggaagtccaaaaggctctgctgctctgaaggggtctgaccaccgccgtgctaccaatgttagcgctagactggacgcacagcagaagaagctcaaccttccagtccttcctacaaccacaattggttcattcccacagactgtggagctcaggagagtccgccgtgagtacaaggcaaaaaagatctctgaggaggagtacatcagtgccatcaaggaggaaatcagcaaggttgttaagatccaggaagagcttgacatcgatgtccttgttcacggcgagcctgagatgaagggaatgttgactggtcccgtcacaatccttaactggtcttttgtcaggaatgaccagccgagaggtttgagacatgctaccagattgctcttgccatcaagaaggaggtcgaggaccttgaggctggtggtattcaggtcatccaaatcgatgaggctgctttgagagaaggtctgcmaytccgcaaggcggagcatgctttctacttggactgggctgttcactccttcagaatcaccaactgcggtgttcaggacaccacccagacagatccacacccacatgtgctactctaacttcaacgacatcatccactccatcatcaacatggacgctgatgtgatcaccatcgagaactcccggtccgacgagaagctgctctccgtcttccgcgagggtgtgaagtatggtgctggcattggccctggtgtctatgacatccactccccaaggatcccgtccacagaggagattgcggaccgcgtcaacaagatgctcgcggtgctcgacactaacattctctgggtgaaccctgactgcggtctcaagacccgcaagtacaacgaggtcaagcccgcccttaccaacatggtttcggccgccaagctcatccgcacccagctcgccagcgcgaagtga

SEQ ID NO: 170 - protein, 768 aa, Oryza sativa
  misc_feature (146)..(146): Xaa = any naturally occuring amino acid
  misc_feature (254)..(254): Xaa = any naturally occuring amino acid
  misc_feature (403)..(403): Xaa = any naturally occuring amino acid
  misc_feature (494)..(554): Xaa = any naturally occuring amino acid
  misc_feature (577)..(577): Xaa = any naturally occuring amino acid
  misc_feature (616)..(617): Xaa = any naturally occuring amino acid
MASHIVGYPRMGPKRELKFALESFWDGKSSAEDLEKVATDLRASIWKQMADAGIKYIPSNTFSYYDQVLDTAAMLGAVPERYSWTGGEIGFSTYFSMARGNATVPAMEMTKWFDTNYHFIVPELGPNTKFSYSSHKAVNEYKEAKXAGVDTVPVLVGPVSYLLLSKPAKGVEKSFALLSLLSSILPVYKEVIAELKAAGATWIQFDEPTLVLDLDSHQLAAFSAAYTELESALSGLNVLIETYFADIPAESYKXLTSLNSVTAYGFDLIRGAKTLDLIKSAGFPSGKYLFAGVVDGRNIWADDLAASLTTLESLEAIVGKDKLVVSTSCSLMHTAVDLVNETKLDSEIKSWLAFAAQKVVEVNALAKALAGQKDEAYFAANAAAQASRRSSPRVTNEEVQKAXAALKGSDHRRATNVSARLDAQQKKLNLPVLPTTTIGSFPQTVELRRVRREYKAKKISEEEYISAIKEEISKVVKIQEELDIDVLVHGEPEXXXXXXXXXXXXXXXXXXXXXXXXXXXXXXXXXXXXXXXXXXXXXXXXXXXXXXXXXXXXXMKGMLTGPVTILNWSFVRNDQPXRFETCYQIALAIKKEVEDLEAGGIQVIQIDEAALREGLXXRKAEHAFYLDWAVHSFRITNCGVQDTTQQIHTHMCYSNFNDIIHSIINMDADVITIENSRSDEKLLSVFREGVKYGAGIGPGVYDIHSPRIPSTEEIADRVNKMLAVLDTNILWVNPDCGLKTRKYNEVKPALTNMVSAAKLIRTQLASAK

SEQ ID NO: 171 - DNA, 1151 bp, Oryza sativa
atggctgacgatttgggccctcccactgtgctccagaagatacatgggcagtccatgatgttcagcaagatctcaccttattctttgatgaagaatcccgcactctacaatgccaacacttcttacagtgtgcctctgaagtcatacaatgggatggatgggaacaatgggttctcatctgtcacatctgtatccccagtctttgcttctgccccaaaggagaaaggtctttctgggtttatgattgacttcatgatgggtggagtttcagctgctgtctccaagactgctgctgctcccattgagcgaatcaagcttctcattcaaaaccaggatgaaatgatcaagagtggtaggctctctcacccatacaaaggtattgcggactgctttggccgcacaattaaggatgaaggtgtgattgcactgtggagagggaacactgctaatgtcatccgttactttcctacccagaggccttgaactttgccttcaaagaccatttcaagcgcatgttcaactttaagaaggacaaggatggttactggaagtggtttgctggaaacctggcttctggaggagctgctggtgcttgctctctcttctttgtgtattctctggattatgctcgtactcgtctggctaatgatgccaaggctgcaaagaagggtggtgggaggcaattcaatggacttgttgatgtttaccgcaagacccttgcgtctgatggtattgctggtctgtacccgtggattcaacatctccctgtgttggtatcattgtctaatcgtgggctgtactttggaatgtatgattctctcaagccagtcgttcttgttggcaaccttcagcaggataacttccttgccagcttcttacttggttggggcattaccattggtgctggccttgcttcatacccaatcgacactgttcgtcgtcggatgatgatgacatctggtgaggctgtcaagtacaacagctccttggatgcgttcaagcagattgttgcgaaggagggtgcgaagtcactcttcaagggcgctggtgctaacattctgcgtgctgttgctggtgctggtgtgcttgctggatatgacaagctgcaggtggtcgtctttggtaagaagtacggttctggtggtggctaa

SEQ ID NO: 172 - protein, 382 aa, Oryza sativa
  misc_feature (159)..(159): Xaa = any naturally occuring amino acid
MADDLGPPTVLQKIHGQSMMFSKISPYSLMKNPALYNANTSYSVPLKSYNGMDGNNGFSSVTSVSPVFASAPKEKGLSGFMIDFMMGGVSAAVSKTAAAPIERIKLLIQNQDEMIKSGRLSHPYKGIADCFGRTIKDEGVIALWRGNTANVIRYFPTQXALNFAFKDHFKRMFNFKKDKDGYWKWFAGNLASGGAAGACSLFFVYSLDYARTRLANDAKAAKKGGGRQFNGLVDVYRKTLASDGIAGLYRGFNISCVGIIVNRGLYFGMYDSLKPVVLVGNLQQDNFLASFLLGWGITIGAGLASYPIDTVRRRMMMTSGEAVKYNSSLDAFKQIVAKEGAKSLFKGAGANILRAVAGAGVLAGYDKLQVVVFGKKYGSGGG

SEQ ID NO: 173 - DNA, 1341 bp, Oryza sativa
atgtccgcaacacagcatacacgtgcactccggtcactcatttgtatgatcactatgtacggtgaaattattattgcagcatcttcaaaggaactcttttgtctaaaggctattctaaatacttcttcctcttcaacaggtttaaaaataaattttagtaagtcttgtatgattcctctgaatgtgcagccagacaaagttgagcatttatccaagatgtttggctgtttggcttttcaagagtatctttcaatgctttctacagataccttagatcagctgtcggatgaatttgataaatggtcttatgtttggggtaatgataagtattcatcccagaaaaaatggagattggaggcactaggcctcagtgcacgggaaacgtgcagtcccactgaaacgcgcacgcgtatgtgtaccctattacctaaacgggaccaaccgaagtcagtcccgggtaaagaggggaaaaatccccccggacgagggacgagcgtcaagtttgggactcgaacgctggtcggcacggaagcgagccactggctcctgccacccgcgctacgcacggtcctcgcatcttggatgctaccaacaacccttttggtcgcctggacgtgtctccgagccaggcccatggaatgcaaaacagcccacggaaacaagacgaatcgagctttgatgcttgtcctggctcgatgcacgccacgacgatgcatccggacccctctattctactggctctcaccatcaccctgcactattacaaaaactctaaagggtgccggttgggaaacccccttcggtgccggtttttccaactggcaaccaggaggcggcactgatcacccaatgtcaaaggtgctggttccaaaaccggcacctttgagatctggcggaggggagggcgcagccgccgggccgtcggaccaccgccgcctcccctcctgccaccgatccgccgccgtcgggccgccgaagccacctcccctcccgccagatctggcggaggaggatttgcatgggcacaaccagggtaaaaaccatagtggctgcgaaagttgtggacagcggccacccttacggcgaagcttgttctgggccgtagctgtggcgaagcgctgcaccgttgtgaggagacgaggcgaccttgcgtcgttgcgcggccgacgcaccatcgccactgtccaagctaaagagcatcggttcctatttcctcctggtttatttttatctttagagcagttgaacgggcccacaaaccgcctggggtgctgctggcatcggctgcgggccggcgacaggaaagcttcaacgctcttggagcacgcgtgcagcgagtga

SEQ ID NO: 174 - protein, 446 aa, Oryza sativa
MSATQHTRALRSLICMITMYGEIIIAASSKELFCLKAILNTSSSSTGLKINFSKSCMIPLNVQPDKVEHLSKMFGCLAFQEYLSMLSTDTLDQLSDEFDKWSYVWGNDKYSSQKKWRLEALGLSARETCSPTETRTRMCTLLPKRDQPKSVPGKEGKNPPGRGTSVKFGTRTLVGTEASHWLLPPALRTVLASWMLPTTLLVAWTCLRARPMECKTAHGNKTNRALMLVLARCTPRRCIRTPLFYWLSPSPCTITKTLKGAGWETPFGAGFSNWQPGGGTDHPMSKVLVPKPAPLRSGGGEGAAAGPSDHRRLPSCHRSAAVGPPKPPPLPPDLAEEDLHGHNQGKNHSGCESCGQRPPLRRSLFWAVAVAKRCTVVRRRGDLASLRGRRTIATVQAKEHRFLFPPGLFLSLEQLNGPTNRLGCCWHRLRAGDRKASTLLEHACSE

SEQ ID NO: 175 - DNA, 816 bp, Oryza sativa
atggggaaggctccgtgctgcgagaagatggggctcaagaagggtccatggacgccggaggaggacaaggtcctcgtcgcccacatccagcgccacggccacggcaactggcgcgccctgcccaagcaagccggcagggctgctgcgttgcggcaagagctgccggctccggtggatcaactacctgcggccggacatcaagcggggcaacttctccaaggaggaggaggacaccatcatccatctccacgagctgcttggcaacagcaggtggtccgcaattgccgccaggttccccgggaggacggacaacgggatcaagaacgtgtggcacaacccacctcaagaagcgcctcgatgcgccggctcagggcggtcatgtcgcggcgagcggcggcaagaagcacaagaagccgaagagcgcgaagaagccagccgccgccgacgccggccgccggcgtcgcccgagcggtccgcctcgtcgtcggtgacggagtcctcgatggcctcgtcggtggcggaggagcacggcaacgccgggatcagctcggcgtccgcgtccgtgtgcgccaaggaggagagctccttcacctcggcttccgaggagttccagatcgacgacagcttctggtcggagacgctgtcgatgccgctggacgggtacgacgtgtccatggagcccggcgacgcgttcgtcgcgccgccatccgccgacgacatggactactggctcggagtgttcatggagtccggcgaagcgcaagacttgccgcagatctagagaaagagagagaattttaccgtttcttcggttaa

SEQ ID NO: 176 - protein, 162 aa, Oryza sativa
MGKAPCCEKMGLKKGPWTPEEDKVLVAHIQRHGHGNWRALPKQAAGLLRCGKSCRLRWINYLRPDIKRGNFSKEEEDTIIHLHELLGNSRWSAIAARFPGRTDNGIKNVWTTHLKKRLDAPAQGGHVAASGGKKHKKPKSAKKPAAADAGRRRRPSGPPRRR

SEQ ID NO: 177 - DNA, 222 bp, Oryza sativa
atgggagattacagagatagccctactggacctgagctagggggagaggctaccgcgcatacacccgtggttaaaccgccgatctcccgccggttagatcgccgccttgccttcggtcaaaccgtcgggacacagaaaacactggcgaccgactacgcctcctggctgcacatgccagaccggctaaggcttccacgtgacgagctgcacggtgtatgctga

SEQ ID NO: 178 - protein, 73 aa, Oryza sativa
MGDYRDSPTGPELGGEATAHTPVVKPPISRRLDRRLAFGQTVGTQKTLATDYASWLHMPDRLRLPRDELHGVC

SEQ ID NO: 179 - DNA, 1688 bp, Oryza sativa
atggcgagctccggtttctcatggacgctgcccgaccaccccaagctccccaaggggaagacggtagccctcgtcgtgcttgacggatggggcgaggccaacgccgacaagtacaactgcatccatgtcgcccagacgcccgtcatggattcgctcaagaataagggtgctcccgagaggtggagattagtgaaggctcatggaacagctgttggtcttcctagcgaagatgacatgggcaacagcgaagtgggtcacaatgctcttggtgctggtcgcatttttgctcaggggctaagcttgtggaccttgctcttgcctctgggaaaatttatgatggagaggggttcaattacatcaaagaatgttttgacaagggtaccctgcaccttattggtttgttgagtgatggaggcgttcactcccgtcttgatcaagtgcagctgcttctgaaaggtgccagtgagaggggagcaaaaagaattcgtgttcacattcttactgatggacgcgatgttttggatggcagcagtgttggttttgtagagacactagagagtgatctttctcagcttcgtgacaagggtattgatgcacggattgcatctggtggtggaaggatgtatgttaccatggaccgctatgagaatgactgggatgtggtcaaacgtgggtgggatgcccaggtgcttggcgaagcaccctacaaattccaaaatgcagtcgaagcagtgaaaactctaagagcagagaccaaggctagtgatcagtatttgcctccatttgtgatcgtggatgagagtggcaaatctgttgggcctgttgtagatggtgatgcagttgtgactttcaatttccgagcggatcgtatggttatgcttgccaaagcactagagtatgcagactttgacaaatttgatcgtgttcgtgtaccaaaaatccggtacgctgggatgcttcagtatgatggtgagttgaagcttccgagccattaccttgtctccccaccagagatagagagaacatctggtgaatacttggtaaagaatggcgtccgcaccttcgcttgcagagtgagacagtgaagtttggccatgtcacatttttctggaacggaaaccgatctggatactttgatgaaactaaggaagagtacgttgaaattcctagtgatattggaatcacattcaatgttaaacccaacatgaaggcacttgaaattgcagagaaagccagggatgccattcttagtggaaagtttgatcaggtaggtacgtgtcaacctgccgaatggtgacatggttggtcacactggtgatattgaagccacggtagttgcttgcaaggcagctgacgaagccgttaagattattttggacgcgattgaacaagtcggtggtatttatcttgtcaccgctgatcatggaaatgctgaggatatggtgaaaagaaacaaatctggccagccacttctcgacaagaacggtggtatccagattcttacctcacatactcttcagccggtcccggttgctattggaggtcccggtcttcaccctggtgtgaaattccggtctgacattcagacccctgggctcgccaatgttgctgcaaccgtaatgaacttccatggtttcgaggctcctgctgactacgaaccaaccctcattgaagttgtggacaactaa

SEQ ID NO: 180 - protein, 562 aa, Oryza sativa
  misc_feature (358)..(358): Xaa = any naturally occuring amino acid
MASSGFSWTLPDHPKLPKGKTVALVVLDGWGEANADKYNCIHVAQTPVMDSLKNKGAPERWRLVKAHGTAVGLPSEDDMGNSEVGHNALGAGRIFAQGAKLVDLALASGKIYDGEGFNYIKECFDKGTLHLIGLLSDGGVHSRLDQVQLLLKGASERGAKRIRVHILTDGRDVLDGSSVGFVETLESDLSQLRDKGIDARIASGGGRMYVTMDRYENDWDVVKRGWDAQVLGEAPYKFQNAVEAVKTLRAETKASDQYLPPFVIVDESGKSVGPVVDGDAVVTFNFRADRMVMLAKALEYADFDKFDRVRVPKIRYAGMLQYDGELKLPSHYLVSPPEIERTSGEYLVKNGVRTFACXSETVKFGHVTFFWNGNRSGYFDETKEEYVEIPSDIGITFNVKPNMKALEIAEKARDAILSGKFDQVVRVNLPNGDMVGHTGDIEATVVACKAADEAVKIILDAIEQVGGIYLVTADHGNAEDMVKRNKSGQPLLDKNGGIQILTSHTLQPVPVAIGGPGLHPGVKFRSDIQTPGLANVAATVMNFHGFEAPADYEPTLIEVVDN

SEQ ID NO: 181 - DNA, 126 bp, Oryza sativa
atggcagttgctccgaggtgcaaacgacgacggcgacgagtgctcgtctgctcgaaggcagaagtggcggtgggtgtttgggggctgcaaacactcaggctcagcggccgccacgtaatcacctag

SEQ ID NO: 182 - protein, 41 aa, Oryza sativa
MAVAPRCKRRRRRVLVCSKAEVAVGVWGLQTLRLSGRHVIT

SEQ ID NO: 183 - DNA, 369 bp, Oryza sativa
atgaagcaaaagatcgtgatcaaggtgagcatgccgtgcgagaagagccggtccaaggcgatgaagctggtggtgatggcctccggcgtgagctcggtggaggtcaccggcgacggcaaggaccggctgcaggtggtcggcgacggcgtcgacgcggcctgcctcgtcacctgcctccgcaagaagatcggccacgcggagctcgtgcaggtggaggaggtgaaggagaagaagccggaggagaagaagccggaggagaagaagccggagccgtgctactgccctcatccctgctactaccaccaccactacggtgggataccggtggccgtcggcgaccagccgagcgacccctgctccatcatgtaa

SEQ ID NO: 184 - protein, 122 aa, Oryza sativa
MKQKIVIKVSMPCEKSRSKAMKLVVMASGVSSVEVTGDGKDRLQVVGDGVDAACLVTCLRKKIGHAELVQVEEVKEKKPEEKKPEEKKPEPCYCPHPCYYHHHYGGIPVAVGDQPSDPCSIM

SEQ ID NO: 185 - DNA, 1064 bp, Oryza sativa
  misc_feature (5)..(5): s = guanine or cytosine
  misc_feature (58)..(58): y = cytosine or thymine
  misc_feature (62)..(62): y = cytosine or thymine
atggscgctctccgagccgctcccgcgagtcgctcctcccgagcttcctctacacctycctyccgccgcgaggggggcggcgcgcccatctcgatccaggctcccagggagaagatcgagatgtactcgccggcgttctacgccgcctgcactgccggtgggatcgccagctgcgggctcacccacatggccgtcacgccgctcgacctcgtcaagtgcaacatgcagcagattgatccagcaaaatacaagagcataacatctgggtttggcgtcctcttaaaggagcaaggacctagaggcttcttcaggggatgggtgcctaccttgcttggttacagtgctcagggcgcatgcaagtttgggttttatgagttctttaagaagtactactcagatattgctgggcctgagtatgctcagaagtacaagaccctaatttacctcgctggatcagcttctgctgaggtgattgcagatgtggctctctgcccatttgaagctgtgaaggttcgtgtgcaaacccaacctggattcgctcgtggactgagtgatgggctccccaagttcgtcagatctgaaggcgctcttggggctttacaagggaattgttcctctgtggggtcgccaaatccctccagatactatgatgaagtttgcctcctttgagaccattgttgaaatgatctacaagcacgctgttcctgttccgaagtctgagtgcagcaagtctttccaattgggtatcagtttcgctggtggttacattgctggagtcttctgtgccattgtctctcatccagctgacaacttggtctctttcttgaacaacgccaagggagctacagtgggtgatgctgttaaaaagcttggtctttggggccttttcactagaggactgccccttcgtattgttatgattggaactcttactggtgctcaatggggtatttatgatgcttttaaagtcatggttggactccaacaaccggtggtgttacgcccgcgcccggtgcagcagagaaagcattgcaagccagtgcttgattcttatgcagagataa

SEQ ID NO: 186 - protein, 348 aa, Oryza sativa
  misc_feature (2)..(2): Xaa = any naturally occuring amino acid
  misc_feature (20)..(21): Xaa = any naturally occuring amino acid
MXALRAAPASRSSRASSTPXXRREGGGAPISIQAPREKIEMYSPAFYAACTAGGIASCGLTHMAVTPLDLVKCNMQQIDPAKYKSITSGFGVLLKEQGPRGFFRGWVPTLLGYSAQGACKFGFYEFFKKYYSDIAGPEYAQKYKTLIYLAGSASAEVIADVALCPFEAVKVRVQTQPGFARGLSDGLPKFVRSEGLLGLYKGIVPLWGRQIPPDTMMKFASFETIVEMIYKHAVPVPKSECSKSFQLGISFAGGYIAGVFCAIVSHPADNLVSFLNNAKGATVGDAVKKLGLWGLFTRGLPLRIVMIGTLTGAQWGIYDAFKVMVGLQQPGGVTPAPGAAEKALQASA

SEQ ID NO: 187 - DNA, 494 bp, Oryza sativa
atggtggtgccgttgctgacgaagaagatcgtgaagaagcgggtgaagcagttcaagaggccgcacagcgaccgctacattggcctcaagagctggcgcaggccaaagggtattgactctcgtgtcaggagaaagttcaaaggatgcaccttgatgcccaacattggatatggttctgacaagaagacaaggcactaccttcccaacaagttcaagaagtttgtggtgcacaatgtctctgagctggagctgcttatgatgcacaacagaacaggacatactgcgctgagattgctcacaacgtctccacccgcaagcgcaaggagatcgtcgagcgcgctgcgcagctggacatcgtggtcaccaacaagcttgccaggctccgcagccaggaggacgagtgaaattttctgcagtttttcgtgcttatggctgcattgttcgtagggcagtgccttggtaccttaaaattatccattttgtgttgctgttag

SEQ ID NO: 188 - protein, 135 aa, Oryza sativa
  misc_feature (31)..(31): Xaa = any naturally occuring amino acid
  misc_feature (91)..(91): Xaa = any naturally occuring amino acid
MVVPLLTKKIVKKRVKQFKRPHSDRYIGLKXSWRRPKGIDSRVRRKFKGCTLMPNIGYGSDKKTRHYLPNKFKKFVVHNVSELELLMMHNXNRTYCAEIAHNVSTRKRKEIVERAAQLDIVVTNKLARLRSQEDE

SEQ ID NO: 189 - DNA, 699 bp, Oryza sativa
atgacgttcgtttcggcgggtggcggagccggtcagcggcggccgcggaggagatcgtcgctggctcagtggtctttggcttcgacgattggagtaaggggtgagacagcatcacgggtgccgcggcggggagcggggcgacgcttgcggtggcaggggatggaggaggtcacggtggtgaggggagggggatcgatctgggcgggaggagaggatttggggaaggagagcacccgtccccgagcttgtggcggcgtatccactggcctggaggaggaggcgctacatgtggcggcggtggagatgacaaggggcgtttcgatgtcatcgctggagaacatgagcacggtcccagactgcggtgtgccagacatcaccacctcctacttgaggtcatccaagagcaccatcgacctcttcacggcagcagctggctcccctgtggcggcgcacagcataatgtcgccaccgcagttcatgggcgccattgacagggaggccagggtgcaccggtacagggagaagaggaagacgaggcggttcgagaagaccatcaggtacgcgtcgcggaaggcgtatgccgagacccggccgaggatcaagggacgcttcgccaagcgcagcgacaccgaccttgaggtcgaccagtacttctccaccaccgccgactccagctgcggcgtcgtgcccacgttctag

SEQ ID NO: 190 - protein, 232 aa, Oryza sativa
MTFVSAGGGAGQRRPRRRSSLAQWSLASTIGVRGETASRVPRRGAGRRLRWQGMEEVTVVRGGGSIWAGGEDLGKESTRPRACGGVSTGLEEEALHVAAVEMTRGVSMSSLENMSTVPDCGVPDITTSYLRSSKSTIDLFTAAAGSPVAAHSIMSPPQFMGAIDREARVHRYREKRKTRRFEKTIRYASRKAYAETRPRIKGRFAKRSDTDLEVDQYFSTTADSSCGVVPTF

SEQ ID NO: 191 - DNA, 1886 bp, Oryza sativa
atgggttcaggactcttcaagcctcgtgttcatccggacctccgtgatgttttctctaagatgtctttctttgacaagattggctttctattcattcatgcatttgacaagagaaacctgtggcacaaggtgcctgttccgatcggtttgctctacctgaacacccgccggaccctgctcgaaaaatacaacctgctagctgttgggaggagttctcacggtgctctgtttgatcccaaggagttcctgtaccgcaccgaggatggcaagtacaacgacccccataatgctgaggctggtagccaaaacaccttttttgggagaaacatggagccggttgatcaacaggatgagagttgatgagcccagatccatttgttgtggcgacaaagctgttagccaggagagaatacaaggacacagggaaacagttcaatatactagcagctgcatggatacagttcatggttcatgactggatggatcatatggaggataccggacagaatgagtgcccactcaaatcgttcaagttccaccccacaaaagaactgcctacgaattctgatggaataaagattggtcactacaatatccgcacagcttggtggggatgggagtgcagtatatggtaataatgaggaaagggcagaaaagctcaggacttatgttgatggaaaactagtgatcggagatgacggtcttcttttgcataaggagaacggtgtggcattatccggcgacattcgcaacagttgggctggtgtttcgatcttacaagctctttttgttaaggaacacaatgcagtttgtgatgcaataaagaggaagaacatcccaacctatcagacgaagaattatatcggtatgccaaattggtcacttctgctgttattgcaaaggttcacactattgattggactgtcgagcttctcaagacaaaaaccatgagagctgcaatgcgcgcaaattgggtatggattattgggtaagaaaataaaagacacatttggtcacataggaggaccgatattaggtgggcttgtgggactgaagaagccgaacaaccatggcgtaccttattctttgactgaagagtttaccagtgtttacagaatgcactccctaataccaagcactctcaagctcagggatccgacagggcaacccgatgcaaataattccccaccatgcctggaagacatcgatattggagagatgattggtctcaagggggaagaacagctatcaaaaatagggtttgaaaaacaagcattatcaatgggatatcaagcttgtggtgcacttgaactatggaactatccaagtttcttcaggaacctcattccacaaaatttggatggtaccaatcgatctgacagaatcgaccttgctgccctagaagaagtataccgagacagggagagaagtgtaccaaggtacaatgagttcaggaggagactatttctgattccaataaaaagctgggaggatctgacaagtgacaaggatgcaattgaaaccataagagcaatatacggagatgatgtagagaaattggatcttcttgttggtcttatggcagagaaaaaaatcaagggatttgccataagcgaaacagcattcaacattttcattttaatggcatccaagaggaggctcgaagcagatcgattttttacaagcaatttcaatgaggaaacatacaccaagaaggggatgcaatgggtcaaaacaacagaaggcctacgagatgtgatcaaccggcactaccctgaaatcactgccaagtggatgaagtcctctagtgctttctctgtgtgggatgcagactactagtgcaaaaattaaaggccccctgccatattatttggcaagttctatga

SEQ ID NO: 192 - protein, 316 aa, Oryza sativa
ELQCAQIGYGLLGKKIKDTFGHIGGPILGGLVGLKKPNNHGVPYSLTEEFTSVYRMHSLIPSTLKLRDPTGQPDANNSPPCLEDIDIGEMIGLKGEEQLSKIGFEKQALSMGYQACGALELWNYPSFFRNLIPQNLDGTNRSDRIDLAALEEVYRDRERSVPRYNEFRRRLFLIPIKSWEDLTSDKDAIETIRAIYGDSAQLGGDGSAVYGNNEERAEKLRTYVDGKLVIGDDGLLLHKENGVALSGDIRNSWAGVSILQALFVKEHNAVCDAIKRKNIPTYQTKNYIGMPNWSLLLLLQRFTLLIGLSSFSRQKP

SEQ ID NO: 193 - DNA, 1108 bp, Oryza sativa
atgggttctacagccgccgacatggccgcggcggccgacgaggaggcgtgcatgtacgcgctgcagctggcgtcgtcgtcgatcctgccgatgacgctcaagaacgccatcgagctgggcctgctcgagacgctgcagtccgccgccgtcgccggaggaagggggaaagcggcgctgctgacgccggcggaggtggccgacaagctgccgtccaaggcgaacccggcggcggccgacatggtggaccgcatgctccgcctgctcgcctcctacaacgtcgtcaggtgcgagatggaggagggcgccgacggcaagctctcccgccgctacgccgccgcgccggtgtgcaagtggctgacgcccaacgaggacggcgtctccatggccgccctcgccctcatgaaccaggacaaggtcctcatggagagctgggtactaccttaaggacgcagtcctggacggcggcatcccgttcaacaaggcgtacgggatgacggcgttcgagtaccacggcacggacgcccgcttcaaccgcgtcttcaacgagggcatgaagaaccactccgtcatcatcaccaagaagctgctcgacctctacaccggcttcgacgccgcctccaccgtcgtcgacgtcggcggcggcgtgggcgccactgtggccgccgtcgtctcccgccacccgcacatccgggggatcaactacgacctcccccacgtcatctccgaggcgccgccgttccccggggtggagcacgtcggcggcgacatgttcgcctccgtgccccgcggcggcgacgccatcctgatgaagtggatcctccacgactggagcgacgagcactgcgcgcggctgctcaagaactgctacgacgcgctgccggagcacgggaaggtggtggtggtggagtgcgtgctgccggagagctccgacgcgacggcgagggagcagggggtgttccacgtcgacatgatcatgctcgcccacaaccccggcggcaaggagaggtacgagagggagttcagggagctcgcccgcgccgccggattcaccggcttcaaggccacctacatctacgccaacgcctgggccatcgagttcaccaagtag

SEQ ID NO: 194 - protein, 368 aa, Oryza sativa
  misc_feature (69)..(69): Xaa = any naturally occuring amino acid
MGSTAADMAAAADEEACMYALQLASSSILPMTLKNAIELGLLETLQSAAVAGGRGKAALLTPARWPTSXPSKANPAAADMVDRMLRLLASYNVVRCEMEEGADGKLSRRYAAAPVCKWLTPNEDGVSMAALALMNQDKVLMESWYYLKDAVLDGGIPFNKAYGMTAFEYHGTDARFNRVFNEGMKNHSVIITKKLLDLYTGFDAASTVVDVGGGVGATVAAVVSRHPHIRGINYDLPHVISEAPPFPGVEHVGGDMFASVPRGGDAILMKWILHDWSDEHCARLLKNCYDALPEHGKVVVVECVLPESSDATAREQGVFHVDMIMLAHNPGGKERYEREFRELARAAGFTGFKATYIYANAWAIEFTK

SEQ ID NO: 195 - DNA, 2053 bp, Oryza sativa
atggcgtctcacattgttggatacccccgcatgggccccaagagggagctcaagtttgccctggagtctttctgggatgggaagagcagcgctgaggatttggagaaggttgcgaccgacctcagggccagcatctggaagcaaatggctgacgctgggatcaagtatatccccagcaacaccttctcgtactatgatcaggttcttgacacgaccgccatgcttggtgctgtcccagagcgctactcatggaccggtggagagattgggttcagcacctacttctcgatggctaggggaaatgccactgtccctgctatggagatgaccaagtggtttgacaccaactacactttatcgtccctgaacttggtcccaacaccaagttctcctactcttcccacaaggctgtgaatgaatacaaggaggccaaggcgctcggcgttgacaccgtgccagtacttgttggaccagtttcatacttgttgctctccaagcctgccaagggtgtagagaagtcgttcgctcttctttcccttctcagcagcatccttcctgtctacaagaggttattgctgagttgaaggcagctggtgctacatggattcagtttgatgagcccacacttgttcttgaccttgactctcaccaattggctgcattctctgcagcgtacacagaactcgagtcggcactttctggattgaatgtgcttattgagacatacttcgctgacattcctgctgaatcatacaaaccctcacatccctgaacagcgtgactgcttatggttttgaccttatccgtggttccaagactcttgaccttgtcaagagtgctggtttcccctctggcaagtacctctttgctggtgttgtggatggacgcaacatctgggctgatgatctcgccgcatctctcaccaccctcgagtctcttgaggctattgttggaaagggacaagcttgtggtctcgacttcctgctcactcatgcacaccgctgtggatcttgtaaatgagaccaagctcgatagcgagattaagtcatggcttgcttttgctgcccaaaaagtggttgaggtgaatgcccttgctaaggcattggctggacagaaggatgaggcttactttgcagcaaacactgctgctcaggcctccaggaggtcatcacctcgtgtgacaaacgaggaagtccaaaaggctgctgctgctctgagggggtctgaccaccgccgtgctaccaatgttagcgctaggttggacgcacagcagaagaagctcaaccttccagtccttcctacaaccacaattggttcattcccacagactgtggagctcaggagagtccgccgtgagtacaaggctaaaaagatctctgaggatgagtacgtcagtgccatcaaggaggaaatcagcaaggttgttaagatccaggaagagcttgacattgatgtgcttgttcacggcgagcctgagaggtttgagacatgctaccagattgctcttgccatcaagaaggaggtcgaggaccttgaggctggtggtatacaggtcatccaaatcgatgaggctgctttgagagaaggtctgcccctccgcaaggcggagcatgctttctacttggactgggctgttcactccttcagaatcacaaactgcggtgttcaggacaccacccagcagattcacacccacatgtgctactctaacttcaacgacatcatccactccatcataaacatggacgccgatgtgatcaccatcgagaactcccggtccgacgagaagctgctctctgtcttccgcgagggtgtgaagtatggtgctggcattggtcctggtgtctacgacatccactcccccaggatcccgtccacggaggagattgcggaccgcatcaacaagatgcttgcggtgctcgacactaacattctctgggtgaaccctgactgcggtctcaagacccgcaagtacaccgaggtgaagcctgccctcaccaacatggttttggccgccaagctcatccgcacccagctcgctagcgcgaagtga

SEQ ID NO: 196 - protein, 684 aa, Oryza sativa
  misc_feature (254)..(254): Xaa = any naturally occuring amino acid
MASHIVGYPRMGPKRELKFALESFWDGKSSAEDLEKVATDLRASIWKQMADAGIKYIPSNTFSYYDQVLDTTAMLGAVPERYSWTGGEIGFSTYFSMARGNATVPAMEMTKWFDTNYHFIVPELGPNTKFSYSSHKAVNEYKEAKALGVDTVPVLVGPVSYLLLSKPAKGVEKSFALLSLLSSILPVYKEVIAELKAAGATWIQFDEPTLVLDLDSHQLAAFSAAYTELESALSGLNVLIETYFADIPAESYKXLTSLNSVTAYGFDLIRGSKTLDLVKSAGFPSGKYLFAGVVDGRNIWADDLAASLTTLESLEAIVGKDKLVVSTSCSLMHTAVDLVNETKLDSEIKSWLAFAAQKVVEVNALAKALAGQKDEAYFAANTAAQASRRSSPRVTNEEVQKAAAALRGSDHRRATNVSARLDAQQKKLNLPVLPTTTIGSFPQTVELRRVRREYKAKKISEDEYVSAIKEEISKVVKIQEELDIDVLVHGEPERFETCYQIALAIKKEVEDLEAGGIQVIQIDEAALREGLPLRKAEHAFYLDWAVHSFRITNCGVQDTTQQIHTHMCYSNFNDIIHSIINMDADVITIENSRSDEKLLSVFREGVKYGAGIGPGVYDIHSPRIPSTEEIADRINKMLAVLDTNILWVNPDCGLKTRKYTEVKPALTNMVLAAKLIRTQLASAK

SEQ ID NO: 197 - DNA, 1200 bp, Oryza sativa
atggccatcgaccacgagtcgccgttcaaggagctccgcctcaagaacaggaggatcatgagggaggaggagggcctgagccggaggaggaggaggcggtggcgcacggagagcagtggccgcggtggctgagcccgctgctctcggccagcttcttctcgcagtgcaaggtgcacgccgactcgcaccggagcggcgagtgcaacatgttctgcctcgactgcgccgccgacgccgacgccgccgccgccgcgctctgctccctctgcctcgcccacaaccaccgcgaccaccacaccatccagcagatccggcggtcgtcgtaccacgacgtgatcagggtgtcggacatccagaggttcatggacatcggcggggtgcagacgtacgtcatcaacagcgcccgcgtggtgttcctcaacgagcgcccccagcacaaggccggcaagggcgccgtcgccaacatctgcgaggtctgcagccgcagcctcctcgacaacttccgcttctgctccctcggctgcaaggtcgtcggctgctccccccacgccgccaccgccgccgccaccgccaccgccaccgccgccaggaggaagagactacgccacgcccacgccatggcctccacctccgactccgacaactccacctcccctgccaagaggagcttcacgccgtccaccccgccgccgccgcccaccctgccgcccaagcgccgcaagggcattccacaccgcgcgccattcggcagcctcatcgtcgagtactagccattgccaaccaacagcaacttcacctgcaggaatccagcgcgtgcgcaattgggaatcgcattgcaaagcggccgccacctcgtcggcctttgcccattgccattaccattgttgccttttggtggtgcttctcgaggtggatgccattagctttgcacaaaggaaaggaggaagatgaagaaaaggaagggtacaaaagcactagcttttccattgctaattgctccattaccattactaggaacacattaaaaatacagacaggatatgtatacatctttaattagtgaccaccccctccctctctctcttgtgttcaaccttctatatagtcttttttttttcattttgagatgtttcaaattttagatgtctttgagcagacttgtagctaatacccctagtggattagcagtgatgataataa

SEQ ID NO: 198 - protein, 317 aa, Oryza sativa
  misc_feature (68)..(68): Xaa = any naturally occuring amino acid
  misc_feature (137)..(137): Xaa = any naturally occuring amino acid
  misc_feature (185)..(185): Xaa = any naturally occuring amino acid
  misc_feature (194)..(194): Xaa = any naturally occuring amino acid
  misc_feature (238)..(238): Xaa = any naturally occuring amino acid
ARCSRPASSRSARCTPTRTGAASATCSASTAPPTPTPPPPRSAPSASPTTTATTTPSSRSGGRRTTTXSGCRTSRGSWTSAGCRRTSSTAPAWCSSTSAPSTRPARAPSPTSARSAAAASSTTSASAPSAARSSAAXPHAATAAATATATAARRKRLRHAHAMASTSDSDNSTSPAKRSFTPSTXAAAAHPAAXSAARAFHTARHSAASSSSTSHCQPTATSPAGPSTPAAAAHPAAXSAARAFHTARHSAASSSSTSHCQPTATSPAGIQRVRNWESHCKAAATSSAFAHCHYHCCLLVVLLEVDAISFAQRKGGR

SEQ ID NO: 199 - DNA, 1089 bp, Oryza sativa
atgggcgtcttggaacggtctgtttgtactttccaggcaaccttgtttttcttctttttgggtaacaggttgacatgtatgcatgcaggtgacatcatgctagctaacaaacacattgtctgcggtcctttgcatctgtcaccgtccaaacatggatcaacagatgagatgtcgtcttctgcaaaggaaaacaagagaaaagaacatttgctatatgtgtatctgctgctgattgatcatgacaatgtgcatgtgcgtatgcatttggtggttgctgatgtgactgtggatgtggaattgggtactttcctgaagatgttcctgggaccagtaaatctgcgggcaccgaggaaggaggtgcagctcaaggtgaaggaagagtataatagctacagggataggactgcattgctttttcttggtttcccaatgattctgttggtactccggtcatggttatggaatggatgcttcccagtattgccagttcagctataccaggcttggttgttgtttctgtatacaactttagctctgcgagagaacatattacgagttaatggaagtgatatccgtccttgtcactatatgtctatacattctaacatgggagataaaggacaacctgattgttctcgaaaacagagaggcgtcgagctgtttctgtgctgggccataatgcaaggtttcgccatgatgttgcagaacagatatcaacgccaaagactatatactcggattgctttaggaaaggctagaagaatggacgttgtgtggggagagactgctggtgttgaaggtcaattgttgctactatgccctgtcctctttctgttgcagggttttgagggttacgttggatttttacttcttcgtactgctcatacaggcatcgtccctgagtggcaggttgtggtctgtggagtcctactgatcgcaatggcgataggtaattttgcaaatacagtggacacgctgatggccaagtccaggttcaaagcaaagaagagatccaggggcaaacgggatcctgacacatgcaactcaccgactggcctatcaccaacaaactcaactgccagagcttga

SEQ ID NO: 200 - protein, 362 aa, Oryza sativa
MGVLERSVCTFQATLFFFFLGNRLTCMHAGDIMLANKHIVCGPLHLSPSKHGSTDEMSSSAKENKRKEHLLYVYLLLIDHDNVHVRMHLVVADVTVDVELGTFLKMFLGPVNLRAPRKEVQLKVKEEYNSYRDRTALLFLGFPMILLVLRSWLWNGCFPVLPVQLYQAWLLFLYTTLALRENILRVNGSDIRPCHYMSIHSNMGDKGQPDCSRKQRGVELFLCWAIMQGFAMMLQNRYQRQRLYTRIALGKARRMDVVWGETAGVEGQLLLLCPVLFLLQGFEGYVGFLLLRTAHTGIVPEWQVVVCGVLLIAMAIGNFANTVDTLMAKSRFKAKKRSRGKRDPDTCNSPTGLSPTNSTARA

SEQ ID NO: 201 - DNA, 489 bp, Oryza sativa
  misc_feature (71)..(71): r = adenine or guanine
  misc_feature (101)..(101): r = adenine or guanine
  misc_feature (121)..(121): r = adenine or guanine
atggtggagcgacttcatctttattatcttcggcactggcaaactctattgctgctacttcgcaagttttrctacttcaccaaccacgacgtctttgtgarcctcgacatctcggcatgcratgccatggagcagacattctacttcaacaacttcaaatatttcggtttagacgagttgggcaacaacatcaactctcctccaattatttgtcttctacggttggcctactacgcaactgccgatagaggatcgtcatcgttatcatcggctgctacatctgctattgactggatcaccgacatcgtcatcttcatcaacatcgtcggatgcgtttgtcggctcgccgattatcttcatcttcatgatgatggtgcgattgtcgccatcaccgttgatgcgcgtctacgtcttcatcgtcggtttgcttttgtcacaccgactgttctttcgttgttgttgggcgcctacatcttcactgctagctga

SEQ ID NO: 202 - protein, 162 aa, Oryza sativa
MVERLHLYYLRHWQTLLLLLRKFCYFTNHDVFVSLDISACDAMEQTFYFNNFKYFGLDELGNNINSPPIICLLRLAYYATADRGSSSLSSAATSAIDWITDIVIFINIVGCVCRLADYLHLHDDGAIVAITVDARLRLHRRFAFVTPTVLSLLLGAYIFTAS

SEQ ID NO: 203 - DNA, 219 bp, Oryza sativa
atggcccgggtatgcggggagcttcgagtagtccgcaacactcctgaggaatcggcgaccggggtttgctcgttctcggaggactccggcggagatagaccaccttgcgaggtcgatgacgccgttagccgagaaggatctgacaaggccttatcggttctgggcatccccagccgaagatcccttaggttcctcggaggccttgtcgagacggcgtaa

SEQ ID NO: 204 - protein, 72 aa, Oryza sativa
MARVCGELRVVRNTPEESATGVCSFSEDSGGDRPPCEVDDAVSREGSDKALSVLGIPSRRSLRFLGGLVETA

SEQ ID NO: 205 - DNA, 1023 bp, Oryza sativa
atggaggagctcgtctcggagatggagatcgtcagctccgtccgccacggcaacgccatgccgctcaccgggttctgcctcgacggcggcggcggcgccgccaagatcatgctggtctacgactacatggcgagaggcagcctcgaggagatcttgcacggtgaaaaggagggaaaagatctgtttggttggccggagaggttcaaggtggccgccggagtagcacgagcgctcgtgtacctccacggcggcgacggcgacggccggccggtgatccacagggacgtcaagtcgtccaacatcctcgtctctgaagatttccaaccaaagctgtgtgacttcggcctcgcgctctgggcggcggaggcggcgtctccggtcaccggcgacgatgtcgccggcacattcgggtttgtagctgcagctgcttcttctcatcttcttgaagaattcaagtacttggctccagagtacttcatgcacggcaaggtcagcgacaagatcgacgtgtacgccttcggcgtcgtcctcctcgagctcgtctccgggaggaagccggtgagctccggcggcggcaagggcaaggagagcctcgtcatgtgggcgaacaccatcatacaaggaggaaagctcactgacctcgtcgaccccagcctgccgacggacggcagcggcgtcgccggcgaggtcgagaggatgaccctcgccgccgccctctgcatccggcgatcgccgcaacgccggcctagcattgcaaatgttctgaaactgctcgacggcgatggcgacgctgtcaggtgggtgaggtcgcaggccggtctgtccgccggcgacgacaccgacgacggcgatggcgcttcgccggagaagaaggacatccagtcgtacatcaaccttgcgctgctcgacgtcgtcgacgactcggcgtccgtcagcagcggcggcggcgacttcacggcggcgaacgtgtcgctggaggagtacacgaaggggagatggagccggtcatcgagcttcgactga

SEQ ID NO: 206 - protein, 340 aa, Oryza sativa
MEELVSEMEIVSSVRHGNAMPLTGFCLDGGGGAAKIMLVYDYMARGSLEEILHGEKEGKDLFGWPERFKVAAGVARALVYLHGGDGDGRPVIHRDVKSSNILVSEDFQPKLCDFGLALWAAEAASPVTGDDVAGTFGFVAAAASSHLLEEFKYLAPEYFMHGKVSDKIDVYAFGVVLLELVSGRKPVSSGGGKGKESLVMWANTIIQGGKLTDLVDPSLPTDGSGVAGEVERMTLAAALCIRRSPQRRPSIANVLKLLDGDGDAVRWVRSQAGLSAGDDTDDGDGASPEKKDIQSYINLALLDVVDDSASVSSGGGDFTAANVSLEEYTKGRWSRSSSFD

SEQ ID NO: 207 - DNA, 3042 bp, Oryza sativa
atggctacagagagcgctgtccggttaattggaggaacggggtctggtaactggagcaaggacttcggtgcatttgactcatcactgggtagtctttcaggagaaggtctggggtttgtggacaataacagtggcgtttatgggggctggagggagtctgtcccaaatcgcagtggaagtgcgccgcctagcatggaagggtctcttgctgctcttggtcatatgataggtcagcagagtgggaacttggaagccactttaggggggaagctgggaaacgtagcggacagttccaaatctgaggagcagctacgtgctgatccggcatactgtgactattatggctccaaggtcaatttgaacccaaggcttccgccaccacttatgtctagggagagcagacgcttcatgaaccgggttggcaaagttaaagaatggagagtggtttctcaagatgacagcaacaaaggttccttgtttattcctcgatctactctgtcaacacacagagaagagcctgaggacgataggtcaccaaggttggattcaagttcagcagaggatgcccaaggttctggtaaaagtggatccaactttgatagccattatacttgtatgaatcttggagattttgcatcggagagttttcagcagaaagccgcttctttgtatgacagttctactcatccatcaaatagcaatactggtgatggtatatctgaccattctgacattaactcatcaacgaatttttcaattgatgctgtcaagacatctgggttgaattcatggacacctgttcctgtgactaacacagtgagaagtacacatagcaacagtatttcatctacatctgttcccagttcatcaagtcctgataacaaccccagtatgcaaacttctcagcaagagaagcctagcatagacatcaagcatgggaatgatgtgcctggcagcggttctattctgactgaactagatactgtgaactccaatatgaagaatctgaggataagtttggatagccatgataccatacatgttaagcagcagtggccggacaatgtcttgcagcagtttggcccctcacctttagtccagggtgatcctattcaaatgattcctcaaggaacacatcttccccatgttccttttgttgagaacttgtcgcatactcaattaaaattaccaactggtgacatgcagcaatttttaccaccgcctggtatgacaacacctttttatgcaccaaattcttttggaagcccttactatcaaaatttgcatccggctagtgtattgccaacaccatttggaactgctggatatgctttgagtggttcagctttaccacctgttatgactagctatgctccccaggtttctgttgctacacctgttgacagccctattactccaagctttagtggtagaccatctggttttccttcaccagggaatcttagtgcaggagcagaatttgttcagccatataaaatgtatggacaacaacttggggttaccatgcagccatccgttcctgacccaaacttctttcagttctttcagcatccttctttactttcatatgctggtataaatcaatacaatacaatgggaccaagggttagtgttgttgggaatcctgctgatagttttgatccccaaaaggtattatcccagcctgcgtatccatctgatcagaggcttcaacttccaagaactggaatttataactctcctgcagccagaagaggaggggccgctccaaattatcaaggcatgacaccatatgttggagcaccaatgacttacccaacaagcccagtgtttcagggacagactttcactggagtattttctcctggtaggagaaatgattctgtgagattccaaactccctcaagaaatatgaccgcttattctggtgttcaagggcagcgagaaagggagaaattcgatgacccaaaggcatgttccttcctggaagaactcaagtctaacagggctcgcagggttgaactatctgatattgcaggccatatagtagaatacagcgctgaccaacatggcagccgattcatccaacagaagttagagaactgcactgctgaagagaaggcatctgtgttttcagaagttctccctcatgcttcatcattaatgactgatgtgtttgggaattatgtgatccaaaagttcttcgaacatggaactcctgaacaaaggagggatcttgccactaagcttgttggtcatgttttacctttgagccttcaaatgtatggatgccgagtaattcaaaaggctcttgaagttatggaacttgaccaaaaaatagaactagttcgtgagcttgatggaaacattatgcgatgtgtccgtgatcaaaatgggaaccatgttatacagaagtgcattgaatgtgttcctacagaacatattggctttgtagtatctgcttttcgggggcaggtggccagcctttcaatgcacccatatggttgccgtgttattcagagagttttggagcactgcggtggtgattcacaaggccagtgcataatagatgagatactggagtcggcttgcgtcctcgcacaagatcagtatggcaactatgttacacagcatgttttggaaagaggaaggggacatgaaaggacccaaattatcagtaaattggctgggcaggttgttaccatgagtcaaaacaaattcgcatcaaatgtgatagagaagtgctttcaacatggggatatgacagagcgagatcttctgatccgggagattgtgaagcagactgagggcaatgataacttgctggcgatgatgaaggaccagtatgcaaactatgtagttcagaagatacttgaaacatgcaacgagcaacagagagagctcctgctcagccgtgtgaagggccatctgcaagcattaaggaagtacacctatggcaagcatattgagacaccgagtcagattcttgaaaaattagcatatttcttcactggaggtgtatgcctggagccctcaagatga

SEQ ID NO: 208 - protein, 1013 aa, Oryza sativa
MATESAVRLIGGTGSGNWSKDFGAFDSSLGSLSGEGLGFVDNNSGVYGGWRESVPNRSGSAPPSMEGSLAALGHMIGQQSGNLEATLGGKLGNVADSSKSEEQLRADPAYCDYYGSKVNLNPRLPPPLMSRESRRFMNRVGKVKEWRVVSQDDSNKGSLFIPRSTLSTHREEPEDDRSPRLDSSSAEDAQGSGKSGSNFDSHYTCMNLGDFASESFQQKAASLYDSSTHPSNSNTGDGISDHSDINSSTNFSIDAVKTSGLNSWTPVPVTNTVRSTHSNSISSTSVPSSSSPDNNPSMQTSQQEKPSIDIKHGNDVPGSGSILTELDTVNSNMKNLRISLDSHDTIHVKQQWPDNVLQQFGPSPLVQGDPIQMIPQGTHLPHVPFVENLSHTQLKLPTGDMQQFLPPPGMTTPFYAPNSFGSPYYQNLHPASVLPTPFGTAGYALSGSALPPVMTSYAPQVSVATPVDSPITPSFSGRPSGFPSPGNLSAGAEFVQPYKMYGQQLGVTMQPSVPDPNFFQFFQHPSLLSYAGINQYNTMGPRVSVVGNPADSFDPQKVLSQPAYPSDQRLQLPRTGIYNSPAARRGGAAPNYQGMTPYVGAPMTYPTSPVFQGQTFTGVFSPGRRNDSVRFQTPSRNMTAYSGVQGQREREKFDDPKACSFLEELKSNRARRVELSDIAGHIVEYSADQHGSRFIQQKLENCTAEEKASVFSEVLPHASSLMTDVFGNYVIQKFFEHGTPEQRRDLATKLVGHVLPLSLQMYGCRVIQKALEVMELDQKIELVRELDGNIMRCVRDQNGNHVIQKCIECVPTEHIGFVVSAFRGQVASLSMHPYGCRVIQRVLEHCGGDSQGQCIIDEILESACVLAQDQYGNYVTQHVLERGRGHERTQIISKLAGQVVTMSQNKFASNVIEKCFQHGDMTERDLLIREIVKQTEGNDNLLAMMKDQYANYVVQKILETCNEQQRELLLSRVKGHLQALRKYTYGKHIETPSQILEKLAYFFTGGVCLEPSR

SEQ ID NO: 209 - DNA, 818 bp, Oryza sativa
  misc_feature (91)..(91): r = adenine or guanine
  misc_feature (337)..(337): m = adenine or cytosine
  misc_feature (340)..(340): k = guanine or thymine
  misc_feature (346)..(346): k = guanine or thymine
  misc_feature (349)..(349): m = adenine or cytosine
  misc_feature (368)..(368): s = guanine or cytosine
  misc_feature (406)..(406): y = cytosine or thymine
  misc_feature (424)..(424): y = cytosine or thymine
  misc_feature (427)..(427): m = adenine or cytosine
  misc_feature (472)..(472): y = cytosine or thymine
  misc_feature (484)..(484): m = adenine or cytosine
atggcgaatccttcaaacctcccatgggggcgatgttccggttcatgtccaagaacggcgccggcgatgggtgcggcggcggcggaggcgraggaggaggaggggtggcgctggaggtgaccgtcttgtcggcggagtcgctgcggctgccgccgccgtcgtattattcgctgatcccgaggcggctgcggccgtacgtgacggtgtcgtcggcggcgtcggcgtgcagcaccggacgtggcggcggcggcgagcggcgagcactcgtggaacgacacgctcgtcgtccccgtgggcgcggagttcctcgaaaacccccggcggcggcggcgtgcamgtkgcggtktamtcggagcccgcgttccggsttgtcggcgggcgcaagccgcttgggttgtgcaggatycccgccgccgaagtgctygamggccttcggccgccgcgcgcgctccgccggctcagctactccctycgctgcccgggmaccggcggccccgcccgcggcgtcgtgcacctcgccgtccgcgtcctcggcgacctcgtcccgccgcctccgccgcagcatgccccgtcgacgccgccggcgcagccagggtggtgccgcgtggcgatgggcatcccggtgtcggggacatccgccgccgtggtggggatgccggcgtgggcggcgtggggcggcgaggcggcggcgtcgcggtgatcgatcgcgacgcggcgaggcaacgagagagactacccgtggaaaaacggtggaaaaattcatcgccgggtcggacttatttttatttattttttgttctgatcgagacgttgactaa

SEQ ID NO: 210 - protein, 224 aa, Oryza sativa
  misc_feature (87)..(87): Xaa = any naturally occuring amino acid
  misc_feature (91)..(91): Xaa = any naturally occuring amino acid
  misc_feature (95)..(95): Xaa = any naturally occuring amino acid
  misc_feature (106)..(107): Xaa = any naturally occuring amino acid
  misc_feature (113)..(113): Xaa = any naturally occuring amino acid
  misc_feature (126)..(126): Xaa = any naturally occuring amino acid
  misc_feature (132)..(133): Xaa = any naturally occuring amino acid
  misc_feature (135)..(136): Xaa = any naturally occuring amino acid
STGSLSRCLAASRSITATPPPRRPTPPTPASPPRRRMSPTPGCPSPRGTTLAAPAASTGHAAAEAAGRGRRGRGRRGARRRGRGRRXPGSXGSSXAGGARAAAEGXXALRRRXSCTTQAACARRQXGTRAPXXPXXARRRRRGFSRNSAPTGTTSVSFHECSPLAAAATSGAATPTPPTTPSRTAAAASGSANNTTAAAAAATPPTRRSPPAPPPLSLRLSAAA

SEQ ID NO: 211 - DNA, 653 bp, Oryza sativa
atggcgtacagggcggaggacgactacgactacctgttcaaggtggtgctcatcggcgactccggggtcggcaaatccaacctcctctcccgcttcacccgcaacgagttcagcctcgagtccaagtccaccatcggcgtcgagttcgccaccaggagcatccgcgtcgacgacaaggtcgtcaaggcccagatctgggacaccgccggccaggagagaggtatcgggcgattacaagtgcatactatcgaggggcagttggcgcacttgtcgtgtacgacgtgacacgccatgtcacctttgagaatgtagagaggtggttgaaggagctccgggatcacacagatgcaaacatcgtcatcatgcttgttggcaacaaggctgatctgcgtcaccttagggccgtatcggttgaggacgccaagggcttcgccgagagggaaagcaccttcttcatggaaacgtccgcgttggagtccatgaatgtagaaagtgccttcactgaggtgctaactcagatctatcgcgtggtcagcaagaaggccctcgacatcggcgatgaccctgctgctccaccaagaggacagaccatcaatgttggtggcaaagatgatgtttctgctgtgaaaaagtctggatgctgttcatcctaa

SEQ ID NO: 212 - protein, 217 aa, Oryza sativa
  misc_feature (72)..(72): Xaa = any naturally occuring amino acid
MAYRAEDDYDYLFKVVLIGDSGVGKSNLLSRFTRNEFSLESKSTIGVEFATRSIRVDDKVVKAQIWDTAGQXERYRAITSAYYRGAVGALVVYDVTRHVTFENVERWLKELRDHTDANIVIMLVGNKADLRHLRAVSVEDAKGFAERESTFFMETSALESMNVESAFTEVLTQIYRVVSKKALDIGDDPAAPPRGQTINVGGKDDVSAVKKSGCCSS

SEQ ID NO: 213 - DNA, 1328 bp, Oryza sativa
  misc_feature (1281)..(1281): k = guanine or thymine
  misc_feature (1287)..(1287): k = guanine or thymine
atggcaggaatggcacccgaaggctcccagtttgatgctaagcactatgacagcaagatgcaggaactacttgaggaattcttcacttcatatgatgaagtttttgagagttttgatgacatgggcctccaagagaaccttctcagaggcatctatgcttatggtggttttgagaagccatcagctattcagcaaagggggattgttcccttctgcaaagggcttgatgtgattcagcaggctcaatctggaaccaggaaaaactgctaccttctgttctgggatcctgcagcaacttgactatggattggtggagtgccaatccctggtccttgcaccaacacgtgagcttgcccagcaaattgaaaaggtcatgcgtgctcttggtgactacttaggtgtcaaggtgcatgcctgtgttggtggaacctctgtccgtgaggaccaaaggattcttgctagtggtgtgcatgttgttgttggcacacctggacgtgtgtttgacatgctacgtcggcaatctctccgcccagaccacattaagatgtttgtgctggatgaagctgatgagatgctctcccgtggtttcaaggatcagtcagatctatgatatcttccagctccttccaccaaagatccaggtcggagtgttctctgctaccatgcctcctgaggcccttgagatcacccgcaagttcatgaacaagcccgtgaggattcttgtgaagagagatgagcttacccttgagggtatcaagcaattctacgtcaatgtggagaaggaagattggaagctcgacactctttgtgacttgtatgagacactggccatcacccagagtgtcatctttgtgaacacccgccgcaaggtggactggctcaccgacaagatgaggagcagggaccacactgtctctgccacacatggagacatggaccagaacactagggacatcatcatgagggagttccgatctggttcttcccgtgtgcttatcaccactgatctgcttgctcgtggtatcgatgtccagcaagtctcccttgtcatcaactacgacctgcccacccagcctgagaactacctccatcgcattggtcgtagtggtcggtttggcaggaagggagttgccattaactttgtcacccgcgatgatgagaggatgctgttcgacatccagaggttctacaatgtgaccatcgaggagctgccggccaacgtcgctgaccttctctagattatgtcttaggaagtaaggttctggataaaagtttgttttkgttttkgttttaatatgaccaactttctcgtttgggaggagtggtaa

SEQ ID NO: 214 - protein, 412 aa, Oryza sativa
  misc_feature (25)..(25): Xaa = any naturally occuring amino acid
MAGMAPEGSQFDAKHYDSKMQELLXEEFFTSYDEVFESFDDMGLQENLLRGIYAYGGFEKPSAIQQRGIVPFCKGLDVIQQAQSGTGKTATFCSGILQQLDYGLVECQSLVLAPTRELAQQIEKVMRALGDYLGVKVHACVGGTSVREDQRILASGVHVVVGTPGRVFDMLRRQSLRPDHIKMFVLDEADEMLSRGFKDQQIYDIFQLLPPKIQVGVFSATMPPEALEITRKFMNKPVRILVKRDELTLEGIKQFYVNVEKEDWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLFDIQRFYNVTIEELPANVADLL

SEQ ID NO: 215 - DNA, 1775 bp, Oryza sativa
  misc_feature (1593)..(1593): y = cytosine or thymine
  misc_feature (1601)..(1601): m = adenine or cytosine
atgagctcccgaatggccggagcgacgctgctgcgccacctgggcccccgcctgttcgccgccgagcctgtgtactccgggctcgccgcgagcgccaggggcgtcatgcccgccgccgcgaggattttccccgcgcggatggccagcaccagcagcgccggcgcggacgtcaaagaaggcgcagccgagaagctgccggagccggcggcaacggcggcggcggcggcgaccgacccgcagaacaagaaggccgtcgtgagctactggggcatccagccgccgaagctcgtgaaggaggacggcacggaatggaagtggctcagttttagggccatgggacacgtacacgtcggacacgtcgatcgacgtgacgaagcaccacgagccgaagggcctcccggacaagctggcgtactggacggtgaggtcgctggcggtgcccagggacctcttcttccagcggcggcacgcgagccacgcgctgctgctggagacggtggccggggtgcccgggatggtgggcggcatgctgctccacctgcgctccctccgccgcttcgagcagagcggcggctggatccgcgcgctgctggaggaggccgagaacgagcggatgcacctgatgaccttcctggaggtgatgcagccacggtggtgggagcgcgccctcgtgctcgccgcgcagggcgtcttcttcaacgcctacttcgtcggctacctcgtctcccccaagttcgcgcaccgcttcgtcggctacctcgaggaggaggccgtgagctcgtacaccgagtacctcaaggacctcgaggccggcaagatcgagaacacgccggcgccggccatcgccatcgactactggcgcctccccgccgacgccacgctcaaggacgtcgtcaccgtcatccgcgccgacgaggcgcaccaccgcgacctcaaccatttcgcatcgggacatccagcaacaggggatgaagctgaaggatacgcctgcgcctatcgggtatcactgaagctactggggcatcgagcagtcgaagaagctggtgcgggaggacggcacggagtggaagtggtcttgctttagggccatgggagacctacaccgcggacacttcgatcgatctgacgaagcaccacgtgcccaagacgctgctcgacaagatcgcctactggaccgtcaagtcgctgcgcttccccactgatatcttcttccagtgctggagacggtggcggcggtgccggggatggtgggcggcatgctgctccacctccggtccctccggcgcttcgagcagagcggcggctggatccgcacgctgctggaagaggccgagaacgagcgcatgcacctgatgaccttcatggaggtggcgaacccaaagtggtacgagcgcgccctcgtcatcaccgtccagggcgtcttcttcaacgcctacttcctgggttacctcctctcccccaagttcgcgcaccgcgtcgtcggctacctcgaggaggaggccatccactcgtacaccgagttcctcaaggacctcgaggccggcaagatcgacaacgtccctgccccggccatcgccatcgactactggcgcytccccgcmaacgccacgctcaaggacgtcgtcaccgtcgtgcgcgccgacgaggctcaccaccgcgacgtcaatcacttcgcatcggacatccattaccagggcatggagctgaagcagacccctgcgccgatcggatatcactgaggatgtttgtctactgccgaggatttgcatcactaa

SEQ ID NO: 216 - protein, 578 aa, Oryza sativa
  misc_feature (531)..(531): Xaa = any naturally occuring amino acid
MSSRMAGATLLRHLGPRLFAAEPVYSGLAASARGVMPAAARIFPARMASTSSAGADVKEGAAEKLPEPAATAAAAATDPQNKKAVVSYWGIQPPKLVKEDGTEWKWLSFRPWDTYTSDTSIDVTKHHEPKGLPDKLAYWTVRSLAVPRDLFFQRRHASHALLLETVAGVPGMVGGMLLHLRSLRRFEQSGGWIRALLEEAENERMHLMTFLEVMQPRWWERALVLAAQGVFFNAYFVGYLVSPKFAHRFVGYLEEEAVSSYTEYLKDLEAGKIENTPAPAIAIDYWRLPADATLKDVVTVIRADEAHHRDLNHFASDIQQQGMKLKDTPAPIGYHTEATGASSSRRSWCGRTARSGSGLALGPWETYTADTSIDLTKHHVPKTLLDKIAYWTVKSLRFPTDIFFQLETVAAVPGMVGGMLLHLRSLRRFEQSGGWIRTLLEEAENERMHLMTFMEVANPKWYERALVITVQGVFFNAYFLGYLLSPKFAHRVVGYLEEEAIHSYTEFLKDLEAGKIDNVPAPAIAIDYWRXPANATLKDVVTVVRADEAHHRDVNHFASDIHYQGMELKQTPAPIGYH

SEQ ID NO: 217 - DNA, 287 bp, Oryza sativa
  misc_feature (16)..(16): m = adenine or cytosine
  misc_feature (78)..(78): y = cytosine or thymine
atggaagtgaagaaamcagtcggcagccatggcaaacgtaggcagcttgtgttgaagatactgatgcctattagtagygacagcgatgtagccagccgtgaagaagatagcatcagttggcgttataacaggccagccgtgcaagcggtgacaccagtcagcggcggatgcggcggccgccggtcggtgaagacgtggatgcccatgaacggtggtgtgaccaaccaaccgtttaggcgaggacaccagtcggcggcgacggaggcaggtcggtggtggagtcgtag

SEQ ID NO: 218 - protein, 94 aa, Oryza sativa
  misc_feature (6)..(6): Xaa = any naturally occuring amino acid
MEVKKXVGSHGKRRQLVLKILMPISSDSDVASREEDSISWRYNRPAVQAVTPVSGGCGGRVGEDVDAHERWCDQPTVXARTPVGGDGGRSVVES

SEQ ID NO: 219 - DNA, 1233 bp, Oryza sativa
atggtcgaggtggaggaagtcagcaacaagatgcaggtgcagatgcgcctccacccgcaggaagggatccgcaagggggtcgacctgctgcggcggtgcgacgagatggtcagtaaggtcggcctcttctcctccaacgagaccaaggatgacatctccaccgccaacctcaaatacctactcgtatcttcaggtaccgtactaccttggggaaatgactgaaagggtagcgcaggaagatcggatcccagtccttaaggcgtcgcaggatcatttgaagaggaattcatttctatctgtgaagcactggagcttatatcagaggatgagcttgaaatatctaggcagaagcaacctgataccatggcaaatcgaagagcacagaagaggttgcacggttcaagcgccaaaaggctgcagaaacaaagctcctagaaatcaaggagaggaaagaaaggcgtaggcggtcattgagagcagctgctttatcagctcctattgaagctggggaggaagatgcttttgaggatgatggagaggaagaaagagagggcatggttagctactatctcattggctctatgcaagtttgaccttcttgacatgttaaagaaggaagaagaaatgcttccggcagtaaaagaaaggaaagcgaagaggatggtaatgcatttgctcgtgaaatgcttgatgaacgtacaaaaagggctgaagcatggcaccataatgctgccaaccgtgcaccatactccaaaccagctgatccaatcacttgtgcaacatttgctcaagatgactaaccagtgaaagagagagaatggcagcacaagtttttcagccaagttatagcatttgctcataaaaaacattagatttcccctgcagcaattaagtgttgagctatagatcatctctattaaagtgatcttgcattgttcagtcctaaaagttagtgaaaatatgcatatgagactatcctttgatccaataattcttaggttgccaacgatgagcatagaagaagctggcttacgtgagatgaaaatgatggagaaatggcaagaaagaactgccaagatgattcaagaatcaaactccgcatggcacaaggatggcagtcggtcagcccaagaggacgaggacgccgaagaggagaaagcgagaggatgggatgactggaaggacgataaccctcgtggtgcaggcaacaagaagctcactccctgtggctaa

SEQ ID NO: 220 - protein, 410 aa, Oryza sativa
  misc_feature (145)..(145): Xaa = any naturally occuring amino acid
  misc_feature (158)..(158): Xaa = any naturally occuring amino acid
  misc_feature (302)..(302): Xaa = any naturally occuring amino acid
MVEVEEVSNKMQVQMRLHPQEGIRKGVDLLRRCDEMVSKVGLFSSNETKDDISTANLKYLLVLQVPYYLGEMTERVAQEDRIPVLKASQDHLKRNSFLSVKHWSLYQRMSLKYLGRSNLIPWQIEEHRRRLHGSSAKRLQKQSSXKSRRGKKGVGGHXEQLLYQLLLKLGRKMLLRMMERKKERAWLATISLALCKFDLLDMLKKEEEMLPAVKERKAKRMVMHLLVKCLMNVQKGLKHGTIMLPTVHHTPNQLIQSLVQHLLKMLTSERERMAAQVFQPSYSHLLIKNIRFPLQQLSVELXIISIKVILHCSVLKVSENMHMRLSFDPIILRLPTMSIEEAGLREMKMMEKWQERTAKMIQESNSAWHKDGSRSAQEDEDAEEEKARGWDDWKDDNPRGAGNKKLTPCG

SEQ ID NO: 221 - DNA, 624 bp, Oryza sativa
atgggcaacgcgatcgccggcgggaggcggcggacggcgagggtgatgacggtggacgggacgacgtacaagtacaggccgccggcgtcggcggcggcggcgctgcgcgaccacccgggctaccaggtcctggagtcggaggaggtcaggcgcctcgggatgcgcgcgcggccgctcgacgccgacgcgccgctcaagcccggcaagctctacttcctcgtcgagctccctcgcctcgcccgcgcgccgcggcgaacgttggagagcatgatgctgtcgcggcggtcggcgtcggacgtggcggcgtcgccggtgtcgtcggtggaggccggcgaaggcggcgccgtgcggctgcggatgcggctgcccaaggcggaggtggcgcggcttgtgaaggagagccgcgaagccgccgaggccgccgagaagatcatgcagctctgcgtcgacagggaccacagctccgcgccggccacccccgtcctccgccgcccgccgccgctgccgctgccgctgccgctgccggcggcgctcgtctcgtcggacaagaagaaggtcgccgacaagaagcagaagaaggcgaggtttatgactgacgtacctgacgagatcatcgacttctga

SEQ ID NO: 222 - protein, 207 aa, Oryza sativa
MGNAIAGGRRRTARVMTVDGTTYKYRPPASAAAALRDHPGYQVLESEEVRRLGMRARPLDADAPLKPGKLYFLVELPRLARAPRRTLESMMLSRRSASDVAASPVSSVEAGEGGAVRLRMRLPKAEVARLVKESREAAEAAEKIMQLCVDRDHSSAPATPVLRRPPPLPLPLPLPAALVSSDKKKVADKKQKKARFMTDVPDEIIDF

SEQ ID NO: 223 - DNA, 451 bp, Oryza sativa
atggaggagctctccaactccaagcaggccggcgacgtcgtcgtcgacggtggtgcaacgaggagcccacacggcggcgacggagacggagctgcgggcgacgacggcggcgatgcgcaggcagccgccgccggagggaggaagaagggggagaagaaggagcggcggccgcggttcgcgttccagacgcgcagccaggtcgacatcctcgacgacggctaccggtggaggaagtacggccagaaggccgtcaagaacaacaaattcccaagaggagctactaccggtgcacgcaccaagggtgcaacgtgaagaagcaggtgcagcggctgtcgcgggacgagacggtggtggtgacgacgtacgagggcacgcacacgcaccccatcgagaaatccaacgacaacttcgagcacatcctcacccaaatgcacatctactccgggcttaa

SEQ ID NO: 224 - protein, 149 aa, Oryza sativa
GGALQLQAGRRRRRRRWCNEEPTRRRRRRSCGRRRRRCAGSRRRREEEGGEEGAAAAVRVPDAQPGRHPRRRLPVEEVRPEGRQEQQIPKRSYYRCTHQGCNVKKQVQRLSRDETVVVTTYEGTHTHPIEKSNDNFEHILTQMHIYSGL

SEQ ID NO: 225 - DNA, 1454 bp, Oryza sativa
atggcgtaccagggcatcgaccttctctcgacgaaagccgcaggcgatgaccacggcgagaattcatcgtacttcgacgggtggaaggcctacgacacgaacccgttcgacctgcggcacaatcgcgggggtgtcatccagatgggtctcgccgagaaccagcagctttctctggacctgatcgaggaatggagcaagaaccaccccgaggcatccatttgcacaccggagggcgtctcgcagttcaagaggatcgccaatttccaggattaccacggcctcccggagttcagaaaggcgatggcccagtttatggggcaggtgaggggaggcaaggcaacgtttgaccccgaccgtgtcgtcatgagcggcggcgccaccggcgcccaggagacgctcgccttctgcctcgccaaccccggcgaggccttcctcgtgcccacgccatactacccagcttcgaccgcgactgttgctggaggtcaggaataaagctgctgccgatcgagtgccacagcttcaacgacttcaggctcaccaaggaggccctcgtgtcggcgtacgacggcgcacggaggcagggcatctccgtcaaggggatcctcatcaccaacccgtccaacccgctcggcaccatcaccgaccgcgacacgctggccatgctcgccaccttcgccaccgagcaccgcgtccacctcgtctgcgacgagatctacgcggggtcggtgttcgccacgccggagtacgtgagcatcgccgaggtcatcgagcgcgacgtgccgtggtgcaacagggacctgatccacgtcgtgtacagcctctccaaggacttcggcctccccggcttccgcgtcggcatcatctactcgtacaacgacgccgtcgtggcggccgcgcgcaggatgtccagcttcgggctcgtctcgtcgcagacgcagtacttcctcgccaggatgctctcggacgaggagttcatcggccgcttcctccaggagagcaagtgtcggctggtggcgcggcacgagcggttcacctctggcctccgcgaggtcgggatcggctgcctgcgcggcaacgccgggctgttctcgtggatggacctgcgccgcatgctccgggagaagacggccgaggcggagctggagctttggcgggtgatcgtacaccaggtgaagctgaacgtgtcgcccggcacgtcgttccactgccgcgagcccgggtggttccgcgtttgccacgccaacatggacgacgagaccatggaggtcgcgctcggccggatccacgacttcgtgcgccagcaccagcagcgcagggtcaaggccgagcgctgggccgccaataggcagctccgcctcagcctgccgcaccaccaccacctcagcccagcccatctctccagtccattggcgctcctgtcgccgcagtccccgatggttcgcgccaccagctga

SEQ ID NO: 226 - protein, 483 aa, Oryza sativa
MAYQGIDLLSTKAAGDDHGENSSYFDGWKAYDTNPFDLRHNRGGVIQMGLAENQQLSLDLIEEWSKNHPEASICTPEGVSQFKRIANFQDYHGLPEFRKAMAQFMGQVRGGKATFDPDRVVMSGGATGAQETLAFCLANPGEAFLVPTPYYPFDRDCCWRSGIKLLPIECHSFNDFRLTKEALVSAYDGARRQGISVKGILITNPSNPLGTITDRDTLAMLATFATEHRVHLVCDEIYAGSVFATPEYVSIAEVIERDVPWCNRDLIHVVYSLSKDFGLPGFRVGIIYSYNDAVVAAARRMSSFGLVSSQTQYFLARMLSDEEFIGRFLQESKCRLVARHERFTSGLREVGIGCLRGNAGLFSWMDLRRMLREKTAEAELELWRVIVHQVKLNVSPGTSFHCREPGWFRVCHANMDDETMEVALGRIHDFVRQHQQRRVKAERWAANRQLRLSLPHHHHLSPAHLSSPLALLSPQSPMVRATS

SEQ ID NO: 227 - DNA, 219 bp, Oryza sativa
atggaacgcatgttcgagggcgaccgcctgcaatcgttgtcggagacgatcacggatatagaaaggaatagtagtagaggcttgagatcccgccagcctatgctggatccgcccctgggcgccacgctcagcgtcgtggccgtgaagctggccgtggccggcctcacgtcggcgacggcgaccctgaccactgaccagcgcggatggagacataattaa

SEQ ID NO: 228 - protein, 72 aa, Oryza sativa
MERMFEGDRLQSLSETITDIERNSSRGLRSRQPMLDPPLGATLSVVAVKLAVAGLTSATATLTTDQRGWRHN

SEQ ID NO: 229 - DNA, 648 bp, Oryza sativa
  misc_feature (286)..(286): r = adenine or guanine
atgccttccccgacctgctacttgctcctcaaccccaccgcctccaggtcccaccaccgtccccgcctccccctccccgccgccgcgccgccgcgcaggcgggtccatgtctcctgcgacgcgcggaggacgggcggcggtggcggtggcggtggggtgaagcgcgaggccatacctgctggaaccggcaaggccaagaagcaggtcgtgttcttcgacgccgcgccaccggtctcgcagcggggcggcggcggcggcggggagggggagggggagggggaggggraagggaaggtggcgaggaggaaggagaacgccgcgttggggttggttaggaggttgacgaagaggacgctgtcgctgctctccaacctcccgctcgccatctccgagatgttcgccattgccgcgctcatggccttaggcacggtgattgatcaaggggaggcgccgagctactacttcgagaagttccccgaggacaacccggtgttcgggttcatcacgtggaggtggatcctcactcccgggttcgatcacatgttctcctcgccggtgttcctcggcctcctcgcgctgctcgcggcgtcgctcatggcctgcacttacaccactcaaatccccattgtcaaggttgccagaaggtag

SEQ ID NO: 230 - protein, 214 aa, Oryza sativa
MPSPTCYLLLNPTASRSHHRPRLPLPAAAPPRRRVHVSCDARRTGGGGGGGGVKREAIPAGTGKAKKQVVFFDAAPPVSQRGGGGGGEGEGEGEGGKVARRKENAALGLVRRLTKRTLSLLSNLPLAISEMFAIAALMALGTVIDQGEAPSYYFEKFPEDNPVFGFITWRWILTPGFDHMFSSPVFLGLLALLAASLMACTYTTQIPIVKVARR

SEQ ID NO: 231 - DNA, 696 bp, Oryza sativa
atgcagcagcagcagctgtgcagcagccactgcctccctgcccgtgccggcagcatcgccagccccggctccggccgccgcgtggtgcccctcggccgccggcgggcgagcctcggaaaggtcacggcgtacgcctacccgacgactcgccgcgtcgtcgatgccgcaaaatccagcctgcttcaggatgtccacgttgctgcctcgaatcccagcctgcagctgctgcaggattatgctcccgccaagaagtcagcaaaacagcagaacggctcaaggacgaaggacgggttttacgaggtcgagatgacggtccaggacgacgagcttgacgagtacggcgtcgtcaacaacgccatctacgccagctacatccacagtggccgtgacgttttccttgaaaatgtcggcgttggcgtggactactggacgtcgacgggcaacgcgctggctctttcagaattgaacctcaagttctacacgcccttacggaaggatgatagattcgtcgtcaggatgaaggtcgtgaagatcaaaggtgtgagaataatcgtcgaacatttgatcgagacgctgccagatcgtaagctcgtagtggatgccaaagcaaccgccgtttgcctcgacaacaaataccgcccaacccgtgtgttcccggagttgtcgacaaagttacatcagttcttcctgtcataa

SEQ ID NO: 232 - protein, 231 aa, Oryza sativa
MQQQQLCSSHCLPARAGSIASPGSGRRVVPLGRRRASLGKVTAYAYPTTRRVVDAAKSSLLQDVHVAASNPSLQLLQDYAPAKKSAKQQNGSRTKDGFYEVEMTVQDDELDEYGVVNNAIYASYIHSGRDVFLENVGVGVDYWTSTGNALALSELNLKFYTPLRKDDRFVVRMKVVKIKGVRIIVEHLIETLPDRKLVVDAKATAVCLDNKYRPTRVFPELSTKLHQFFLS

SEQ ID NO: 233 - DNA, 1025 bp, Oryza sativa
atggccgaggtgaacggagccaataacggcaacggccaccacggccacggcaacggcagcggcgctgcggcggcggcggggcggtcgacgagtgtgtcgaggaagatcgagtcggagggggcggtgctgatgcccggggtgtacgacgcgctgtcggcggcgatcgtccagaagaccgggttctacgccggcttcatctccggctacgccgtctccggctccttcctcggcacccccgacgtcggcctcctcacccgccggagatggcggaggtggcgaggcggatctgcgcgtcggcgcccaacacactcttcatcgccgacgccgacactggtggtggcaatgctctgaatgtgaagcgtactgttcaggacctgatggcagcaggtgctgcaggctgcttcctcgaggtgataccagcagaggagcacgctgtgaagatagctgcagcgagagaggtcgttggtgatcgggacttctttatcgtggcccggactgacgctcgatctgtcactggtcttgatgatgccattaggcgtgccaatctctacatagatgcgggagcagacgcgtgcttcgtggaggcgccgcggagcgacgaggagctgatggagatctgcaggaggaccaagggttatcgcgtgtgcaacatgctggagggcgggaagacgccgctgcacacgaggcaggagctcatggagatggggttccacctcatcaagtcccccctcaccaccgtctacgctgccgcccgcgccctcgtcgacgtcctcgccgccctcaagcgcgccgagaccacccgcgacgagctccaccgcctcaccaccttcaccgagttcaacaacctcgtcggcctcgactcctggctcgacatcgaggttcgcttctccgtcaactcctcctcctccgttcccaagccgctcccggcaccaccggcgctggagaccacgacggagatggagaaggccaaggccaaggcggccgccgtcgtcgccggaaacggagctaccaatggggtacactaa

SEQ ID NO: 234 - protein, 340 aa, Oryza sativa
MAEVNGANNGNGHHGHGNGSGAAAAAGRSTSVSRKIESEGAVLMPGVYDALSAAIVQKTGFYAGFISGYAVSGSFLGTPDVGLLTPEMAEVARRICASAPNTLFIADADTGGGNALNVKRTVQDLMAAGAAGCFLEVIPAEEHAVKIAAAREVVGDRDFFIVARTDARSVTGLDDAIRRANLYIDAGADACFVEAPRSDEELMEICRRTKGYRVCNMLEGGKTPLHTRQELMEMGFHLIKSPLTTVYAAARALVDVLAALKRAETTRDELHRLTTFTEFNNLVGLDSWLDIEVRFSVNSSSSVPKPLPAPPALETTTEMEKAKAKAAAVVAGNGATNGVH

SEQ ID NO: 235 - DNA, 1665 bp, Oryza sativa
atggagatggccatcgccatcgccgttggcctcggcggcagcagcggggaggcagacgtgcgcggtggagtcggtgcggctggagcagcggcggccaccatgcctgacgggcgaagggggcggtggccccgggagaaggaggcagtggtgttgccaccgccgttgaccacctcacctctctcgtctcccacctccacggccgacgggcgaaggggcggcggcaccgggagaggagggcatcagccggagatggcggtggcggattggagggggaaacgcggcagtggcggcagaccgacgagcggcctcgcgtcagcgggagaggagggggcatcggccggtgacggcggtggcaaattagaggggggaaacgcggcgatagcagcaggctgggaagatcctctccccgtgggtggcggcggtgggggaggaactcgccgccttgccgggagctcgcctcgcctactggtgcggtgcccggcgctggaccgccaggcggcgcgcgccaaccgcctccgcttcgcccgcaagctcctcgtcctgctcctctccaagccgcgccgcttcctcccggctccgcgtgctccgcgctgccaccgctacctcggcctcccgccgcaccgccgccgccgcccgctggcgcccacgtcgcacccgctctcgcccaacctctccaccctcgccgtcgcgctcacccccgccgcggaggcgctcgccgccgacctcgccgcgctccgtggctcctccgagctcgcgccacgcctcgccgccaagatgcaccgcctcctccttctggcacccgggcggagcctcctcgtgtccaagattgctcacctcgcacccgatctcggcctcgccatggacttccgcgccaagctctgcccgcagcaccccgaccttttcaccttcgtgaacacctcccacggccacgcactccagctagtcgatcccccgccgccaccgcctccgccgctcccgcctttccgccccgcggcgccatccgaccgcctcattgaccggccacgaaggttcccccacctcaagctccggcgagggctcaacctccgccgcgcgcaccgggattacctcttgcggttccatagcctgcccgaggtgtcgccattcgagccactcgatgagggcgcaagcttggagatgatggagcgacgggcgtgcgcggttgtccgggaggtcctggccatgactgtggagaagagaacactgttcggcaccccagagttgttctatgttagtgtcaaggggttgcggcactcggtgttccttgtcgaggcgttcgacgatgacggtaggctacttgtggaggatgatatgcttgttgcgagggatcggcttgaggagcttgtccgcgaggggaagcggatgaggcgggctaagaagaagggccttcttgctcttgcggatgacagtgatgaagatgatgaagaggaggatggggaagaacaggattcggtacaggtcgatggtgaatcttgggacttgttagaggatggtggcattggcgaggactgggaggaggtgggtgatcttggtgaggggagcgatgacgatgctgatgctgaattggatgcgttggaggagttttgggtgaagaaagctgtggccgaggggttggttgacactgggagcgagcttgatgcttggtga

SEQ ID NO: 236 - protein, 554 aa, Oryza sativa
MEMAIAIAVGLGGSSGEADVRGGVGAAGAAAATMPDGRRGRWPREKEAVVLPPPLTTSPLSSPTSTADGRRGGGTGRGGHQPEMAVADWRGKRGSGGRPTSGLASAGEEGASAGDGGGKLEGGNAAIAAGWEDPLPVGGGGGGGTRRLAGSSPRLLVRCPALDRQAARANRLRFARKLLVLLLSKPRRFLPAPRAPRCHRYLGLPPHRRRRPLAPTSHPLSPNLSTLAVALTPAAEALAADLAALRGSSELAPRLAAKMHRLLLLAPGRSLLVSKIAHLAPDLGLAMDFRAKLCPQHPDLFTFVNTSHGHALQLVDPPPPPPPPLPPFRPAAPSDRLIDRPRRFPHLKLRRGLNLRRAHRDYLLRFHSLPEVSPFEPLDEGASLEMMERRACAVVREVLAMTVEKRTLFGTPELFYVSVKGLRHSVFLVEAFDDDGRLLVEDDMLVARDRLEELVREGKRMRRAKKKGLLALADDSDEDDEEEDGEEQDSVQVDGESWDLLEDGGIGEDWEEVGDLGEGSDDDADAELDALEEFWVKKAVAEGLVDTGSELDAW

SEQ ID NO: 237 - DNA, 1605 bp, Oryza sativa
  misc_feature (301)..(301): r = adenine or guanine
atgggcataacagtcattttcccctcctcctccacgaacatcgtcttcttcccctctcgcaagctaaagctgtgccgttctcttccagaagcttccgccgccgccgccaaccgagccgctccgatcctccccccctcgactcggccgcgggcgtacgtagagggggaccgaccagatggtggcggcgtcgcgcctcctcgcgcgggcgtcgaggcaatgcgtcgccgcggtggcggcgtcggccgcgaggcggcggcggtgcccggcggcggcgctgtcgctgcccgtggtgaccgcggcraaggcggcggctgcggagccgtggctcggggtgagaatccttctatgcttcctctcgtggatgtgccgtttcaggtcccatatatgttgaatcagcccttgagatactcaaccaccatttttcaacgttttggattttcatccacttccccggaactaagtgataaggaggaaaaccaacgcaaggaccaggagaattccacaaatgtgtcaaatgaaggcactgaagacgttgatttgtcaaaggaggatctggtgcagctagttcttgagaaggatggattgttgaagtcaaaagatgaagaaatcaatgatatgaaggacaaggttttgcgaagttatgcagaaatggaaaatgtcatagctaggacaaagcgtgaatctgagaactcaaaaaagtatgctgtgcagaatttctccaagagcctgttagatgtcgctgacaatttgactagagcatcatctgttgttaaggaaagcttctcaaaaatagatacatctaaagattctactggagctgttccactactaaaaacactgttggagggtgtggacatgacagataaacaacttggtgaggtttttaagaagtttggagttgaaaagtttgatcctttgaatgagaaatttgatcctagtagacattgtgcaatctttcaaattcctgacccctcgaaaccttcaggaactgtagcttctgttgtaaagaagtcggtgttacagagggaggccccacgaccacggaggaggcagcagaaaattctgagcagaaatcgagtgaggtttaagtttgctgctgttacttcacttaacgagatagttggaacgatgtcccattttggtcctggagatgaggatgagccatcgttggttacttccactgtcacgttgctcttctgcgctcagatcagcatcgctgtcgtcatctggatcttccaacccaaggttcaaattcagctcggtgctgccgctcttcttgaagagggagcacttctgttgtacggtttgctgagatggcatccagtcaggaatggtctgtggctctgtgctgcctacatggacaaatttagccacacttttgcttcctacagtagtaccgatgctgctcctctgtttaggcaatccgtccatggtcacgagctcaaggccgcagcaactcctgctgggattgcttctcactctgttcctggatgggaaggcagaggggaaaattttgacctggtaggagatctgtacgcagcaatggatgatgagattttctggagggagacgggaggaagagggagatatcctaatgataactga

SEQ ID NO: 238 - protein, 534 aa, Oryza sativa
MGITVIFPSSSTNIVFFPSRKLKLCRSLPEASAAAANRAAPILPPSTRPRAYVEGDRPDGGGVAPPRAGVEAMRRRGGGVGREAAAVPGGGAVAARGDRGQGGGCGAVARGENPSMLPLVDVPFQVPYMLNQPLRYSTTIFQRFGFSSTSPELSDKEENQRKDQENSTNVSNEGTEDVDLSKEDLVQLVLEKDGLLKSKDEEINDMKDKVLRSYAEMENVIARTKRESENSKKYAVQNFSKSLLDVADNLTRASSVVKESFSKIDTSKDSTGAVPLLKTLLEGVDMTDKQLGEVFKKFGVEKFDPLNEKFDPSRHCAIFQIPDPSKPSGTVASVVKKSVLQREAPRPRRRQQKILSRNRVRFKFAAVTSLNEIVGTMSHFGPGDEDEPSLVTSTVTLLFCAQISIAVVIWIFQPKVQIQLGAAALLEEGALLLYGLLRWHPVRNGLWLCAAYMDKFSHTFASYSSTDAAPLFRQSVHGHELKAAATPAGIASHSVPGWEGRGENFDLVGDLYAAMDDEIFWRETGGRGRYPNDN

SEQ ID NO: 239 - DNA, 1410 bp, Oryza sativa
  misc_feature (418)..(418): s = guanine or cytosine
atggccgcggcctccctctccgacgacctggagcccgccaccgaccgcacccgcatccgatccatcctggccgacggcgccgcgcgcgccggcgagcgcgtcgtcgtgggcgggtgggtcaagaccgggcgggagcaggggaaaggcaccttcgccttcctcgagctcaacgatggctcctgcgcctccaacctgcaggtcctcgtcgacgccgccgtccacccgctcgcgccgctcaccgccacgggcacgtccgtgctcgtcgagggcgagctcaagaagccgccggagggcgccaagcagcgcgtcgagctccgcgtcgaccgcgtcatcgaggtcggcgaggtcgaccccgccgcctacccgctgcccaagaccaagctcacgctcgagaatctcagggacgtcgtccatctcsgctcccgcaccaacacgattggtgctgttgcgcgtattagacaccagctagcctgtgcaacacacaggttttttgatgagaatggttttctttatgtgcacacaccaataataactacaagtgattgtgagggtgctggtgagatgtttcaagtgacgactttgttcagccatgctgaaaaggtggagaaggaattgaaagagaaccctgcaccatcagagtctgatattgaggcagctagagttgttgtcaaggaaaaaggtgatgcggttgcacagcttaaagctgcaaaagctagcaaacaagaaatcacagctgctgttgctgagcttaacaaggcaaaagaaaatgtctcaaggctggaggaaagatggatgatatgaactgtgcagaaagatatgtacagtacctttgcaagtggcttcttgagcattgccgggaagacatggaattcatggtgaaaaattacgataagactgcaattgagcgtctggagcttgtttcctcgacaccttttcagcgcatttcatatacaaaagctgttgagctattgaaaaatgtcactgataagaaattcgaaaacaaggttgaatggggaattgatttagcttcagagcatgaaagaggtatttaaccgaggtgatatttaagaagccggtgattgtttataactatcccaaagaaataaaggcattttatatgagactcaatgatgatcagaagactgtagctgctatggatgttcttgtgcccaagccaaaggttggtgagttggttggtggaagccaaagggaggaacgtctggaccttctcaaaacaaggggttgcctttggagccatatgaatggtacttggacctccgccgctttggatctgtcaagcacagtggttttggtttgggttttgaaagaatgattctttttgccactggtttggagaacatcagagatgtcatccccttccctagatacccagggagggctgatctctaa

SEQ ID NO: 240 - protein, 469 aa, Oryza sativa
  misc_feature (140)..(140): Xaa = any naturally occuring amino acid
MAAASLSDDLEPATDRTRIRSILADGAARAGERVVVGGWVKTGREQGKGTFAFLELNDGSCASNLQVLVDAAVHPLAPLTATGTSVLVEGELKKPPEGAKQRVELRVDRVIEVGEVDPAAYPLPKTKLTLENLRDVVHLXSRTNTIGAVARIRHQLACATHRFFDENGFLYVHTPIITTSDCEGAGEMFQVTTLFSHAEKVEKELKENPAPSESDIEAARVVVKEKGDAVAQLKAAKASKQEITAAVAELNKAKENVSRLEERDDMNCAERYVQYLCKWLLEHCREDMEFMVKNYDKTAIERLELVSSTPFQRISYTKAVELLKNVTDKKFENKVEWGIDLASEHERRYLTEVIFKKPVIVYNYPKEIKAFYMRLNDDQKTVAAMDVLVPKPKVGELVGGSQREERLDLLKTRGLPLEPYEWYLDLRRFGSVKHSGFGLGFERMILFATGLENIRDVIPFPRYPGRADL

SEQ ID NO: 241 - DNA, 692 bp, Oryza sativa
atgttcattaatgccaaacttattattgtctactgttgcagtaagttgcagagtgatgctctgagagaagcgatctctcaaattgctaatgactctcgtgagaagcagcgcaaatttgtggaaaccattgagctgcagattggactgaagaactatgaccctcaaaaggataagcgtttcagtggttctgttaagctgccccacatccctcggcctaagttgaaggtttgcatgcttggtgatgctcagcacgtcgaagaggcagagaaaatgggcctagactatatggatgtggaagccctcaagaaaatgaacaaaaacaagaagctagttaagaagcttgcaaagaaatatcatgctttccttgcttctgaggctatcatcaagcagattcctcgacttcttggtcctggtcttaacaaagcaggcaggcaaattcccaactctggtgacgcatcaggaatcacttgagtccaaggttaatgagactaaggctacagtgaaattccagctgaagaaggttctctgcatgggtgttgctgttggcaactgtgctatggaggagaagcagatcttccaaaatgtgcagatgagcgtgaacttccttgtttcccttttgaagaagaattggcagaacggttaggtgcttgtacctgaagagcaccatgggaaaggtgtaccgagtgttctaa

SEQ ID NO: 242 - protein, 229 aa, Oryza sativa
MFINAKLIIVYCCSKLQSDALREAISQIANDSREKQRKFVETIELQIGLKNYDPQKDKRFSGSVKLPHIPRPKLKVCMLGDAQHVEEAEKMGLDYMDVEALKKMNKNKKLVKKLAKKYHAFLASEAIIKQIPRLLGPGLNKAAGKFPTLVTHQESLESKVNETKATVKFQLKKVLCMGVAVGNCAMEEKQIFQNVQMSVNFLVSLLKKNWQNVRCLYLKSTMGKVYRVF

SEQ ID NO: 243 - DNA, 1327 bp, Oryza sativa
atggcggtgacgatccagtccgtgaaggcgaggcagatcttcgacagccgcgggaaccccacggtggaggtggacgtgggactcagcgatggcagcttcgcgaggggcgccgtgccgagcggtgcttccaccgggaatatatgaggccttggagttaagagatggaggatccgactatcttggcaaaggtgtactcaagttggcaggctgtgagcaatattgataacttcatggttcaacagcttgatggaacctccaacaactggggctggtgcaaacaaaagaaacaatgacagcttggagcaaatgctattcttgctgtttcacttgctgtgtgcaaagcaggagccatggtgaagaagattcccctttaccagcagcacattgcaaatcttgctggaaacaagactctcgtgctgcctgtacccgctttcaatgtgatcaatggaggatcccatgctggaaacaaacttgccatgcaggctgtacaggagttcatgatcctccctactggtgcatcctctttcaaggaggccatgaagatgggagttgaggtgtaccaccacttgaagagtataatcaagaaaaagtatggccaagatgccacaaatgtgggggatgaaggtggctttgctcctaacattcagcaggaaaacaaagagggcctcgaactgttgaaggccgcaatagctaaggctggctacacaggcaaaaggtggtcataggaatggatgttgcagcttctgaattttacagtgaaaaggacaagacttacgatcttaacttcaaggaggataacaacgacggttcacacaaaatttcaggtgacagcctgaaagatgtgtacaagtcctttgtttctgagtaccctattgtgtcgatcgaagatccattcgatcaggatgactgggctacctatgccaagcttactgatgagattggacagcaagtgcagattgttggggatgaccttcttgttactaatcccacaagggttgccaaggcaattagtgaaaagacttgcaatgctcttctcttgaaggtgaatcaaataggctcagttactgagagcattgaggctgttagaatgtccaagcgtgctggatggggagtgatggcaagccataggagagtggtgagacagaggataccttcattgctgacctctcagttggtctgtctacggggtcaaattaagacaggagctccctgtcggtcagagcgtctggctaaatacaaccagcagctgctcaggatagaagaagagctgggcgatgctgcagtttacgctggagaaaaattcagagcccctgtggagccgtactaa

SEQ ID NO: 244 - protein, 452 aa, Oryza sativa
  misc_feature (87)..(90): Xaa = any naturally occuring amino acid
  misc_feature (102)..(109): Xaa = any naturally occuring amino acid
  misc_feature (248)..(248): Xaa = any naturally occuring amino acid
  misc_feature (388)..(388): Xaa = any naturally occuring amino acid
MAVTIQSVKARQIFDSRGNPTVEVDVGLSDGSFARGAVPSGASTGIYEALELRDGGSDYLGKGVLKWQAVSNIDNFMVQQLDGTSNXXXXLGLVQTKETMTXXXXXXXXLGANAILAVSLAVCKAGAMVKKIPLYQQHIANLAGNKTLVLPVPAFNVINGGSHAGNKLAMQAVQEFMILPTGASSFKEAMKMGVEVYHHLKSIIKKKYGQDATNVGDEGGFAPNIQQENKEGLELLKAAIAKAGYTGXKVVIGMDVAASEFYSEKDKTYDLNFKEDNNDGSHKISGDSLKDVYKSFVSEYPIVSIEDPFDQDDWATYAKLTDEIGQQVQIVGDDLLVTNPTRVAKAISEKTCNALLLKVNQIGSVTESIEAVRMSKRAGWGVMASHRXSGETEDTFIADLSVGLSTGQIKTGAPCRSERLAKYNQQLLRIEEELGDAAVYAGEKFRAPVEPY

SEQ ID NO: 245 - DNA, 944 bp, Oryza sativa
atgggttcacacttgtcgattccggtcaaagaaaaaagctttttcacggtcccatcacaccaatctacgcaacttgcagtcgtcgagcttggatggaccatgttcggtgctacttgtttggggcatgtctggattcaggcttcttctatgtggtggatcatggaataagccaggagttaatggatgatgtttttgcccagagcaagaaattctttgaccttcccatcaatgagaaaatggagcttctccgggatgagaagaatcgaggctatacacccatgctagatgagattcttgatccagaaaatcaagtgaatggaagtattgccaagatggaggaaggtgatggaacagtatcatagcgaggccctgagggtggcaaaatcaattgcaaggattattgcccttgctctaaacctagaagaggacttctttgataaaccagaaatgcttggcgagcccatagccacattaaggctcctgcattatgaaggtggacaaaaaacagaggtaaagtatcaaatcctgcagagggagtttttggagcaggtgcccattctgattatggcctaatcactctactggcaaccgatgatgtagttggtctccaaaaggacaggaatgctcagcctcaagtatgggaatatgaggttttattgtcaatcttggcgatatgctcgaacggtggagtaactgtattttcagaggtcaaccttacatcgagtggtcttagatggacgagaacgtcattctattgcgttctttgtggaaccaagccacgattgcgtagtcgagtgcctgccaacctgcaaatctgaatcaaatcctccaaagttccctccgatcacttgctcggcatacctatcgcagcggtacaaggatacgcatgccgatctgaccgcttacagcagcaacaaggcctagaaggccaagcgccattttga

SEQ ID NO: 246 - protein, 313 aa, Oryza sativa
  misc_feature (170)..(170): Xaa = any naturally occuring amino acid
  misc_feature (217)..(222): Xaa = any naturally occuring amino acid
  misc_feature (241)..(241): Xaa = any naturally occuring amino acid
MGSHLSIPVKEKSFFTVPSHQSTQLAVVELGWTMFGATCLGACLDSGFFYVVDHGISQELMDDVFAQSKKFFDLPINEKMELLRDEKNRGYTPMLDEILDPENQVNEVLPRWRKVMEQYHSEALRVAKSIARIIALALNLEEDFFDKPEMLGEPIATLRLLHYEGGQKTXGKVSNPAEGVFGAGAHSDYGLITLLATDDVVGLQKDRNAQPQVWEYXXXXXXGFIVNLGDMLERWSNCIFXRSTLHRVVLDGRERHSIAFFVEPSHDCVVECLPTCKSESNPPKFPPITCSAYLSQRYKDTHADLTAYSSNKA

SEQ ID NO: 247 - DNA, 470 bp, Oryza sativa
  misc_feature (21)..(21): r = adenine or guanine
atggcgaagctgtacgtgcargcggtgccgccgccggatctgaacaggaacacggagtggttcatgtacccgggcgtctggacgacctacatctgcatcctcttcttctcctggctcctcgtcctctccgtcttcggctgcacgcccggcatggcctggaccgtcgtcaatctcttccacttcgcgacataccactttttccattggaagaagggaacaccttttgctgatgaccagggaatgtacaacacattgacttggtgggagcaaatggacaatggcaaacagcttactcgcaacaggaagttccttgttgtagttcctgttgtccttatttgatagcttcacacactacagactaccaacatcctatgctcttcctcaacacccttgcagtcgcagtgctcgtggtcgctaaactaccgaacatgcacaaggtccggatttttggaattaatgctgggaactag

SEQ ID NO: 248 - protein, 157 aa, Oryza sativa
  misc_feature (112)..(112): Xaa = any naturally occuring amino acid
  misc_feature (130)..(130): Xaa = any naturally occuring amino acid
MAKLYVQAVPPPDLNRNTEWFMYPGVWTTYICILFFSWLLVLSVFGCTPGMAWTVVNLFHFATYHFFHWKKGTPFADDQGMYNTLTWWEQMDNGKQLTRNRKFLVVVPVVLXLIASHTTDYQHPMLFLNXTLAVAVLVVAKLPNMHKVRIFGINAGN

SEQ ID NO: 249 - DNA, 759 bp, Oryza sativa
atggcatcgctgcgtgggcgcggcatggtgttcgacggggtgtacgtggtgtcggaccttacgcggctcttcgcggagctagactttgggcgcggggactgggtcattagcggcatggcacagccgatgctggcgactttcctggtgaggtgcaggaacaccgacggcgaggacgcggtggcggcgtcgatgctactgccgctccgctcattagttttgatgggatggctcattagagcaaggataatggggtactacggcaacgcgctcacctactctatcgccgacgccagcgccagtgatctgtgcggcggcacgctggggcagatggtggagctctctatcgccgacgccagcgccagtgatctgtgcggcggcacgctggggcagatggtggagctcgtctgcgaggcgaggctacgagtgagggaggagtatgtgagatcaacagtggacttgatggcgttgctgcgtgggcgcggcatggtgttcgacggggtgtacgtggtgtcgaacctgacgcggctcttcgcggagctggactttgggcgcggggagtgggtggttagcggcatggcacagccgatgctggcaacgttcctggtgacgtgcaggaacggcgacgacgaggacgcggtggcggcatcgatgctgttgccgcctccggtgaagttgaggtttgcagaggagcttgctgggctgatgatgagcagtaagcacgacaagggtgctattacaacctccagctcccgactttag

SEQ ID NO: 250 - protein, 252 aa, Oryza sativa
MASLRGRGMVFDGVYVVSDLTRLFAELDFGRGDWVISGMAQPMLATFLVRCRNTDGEDAVAASMLLPLRSLVLMGWLIRARIMGYYGNALTYSIADASASDLCGGTLGQMVELSIADASASDLCGGTLGQMVELVCEARLRVREEYVRSTVDLMALLRGRGMVFDGVYVVSNLTRLFAELDFGRGEWVVSGMAQPMLATFLVTCRNGDDEDAVAASMLLPPPVKLRFAEELAGLMMSSKHDKGAITTSSSRL

SEQ ID NO: 251 - DNA, 746 bp, Oryza sativa
  misc_feature (15)..(15): s = guanine or cytosine
  misc_feature (105)..(105): r = adenine or guanine
  misc_feature (158)..(158): y = cytosine or thymine
  misc_feature (629)..(629): k = guanine or thymine
atgtattcagggccsccgggaaagggaaggaggtgctcagcggcgtggtcttccagccattcgaggagctcaaagggggagctctccctcgtcccccagggccarggaccagtctccttgctaggcaaaagttcgtcgacgattgcgaggccgcaatytgcgagcagatcaagtggagttcaatgcatcgtacgcgtaccactcccttttcgcctactttgaccgtgacaacgttgctctcaagggattcgccaattcttcaaagaatccagcgatgaggagagggatcacgcagagaaactcatgaagtaccagcagaacatgcgtggaggcagggtgcggctccagtccatcgtcacacccttgacagagttcgaccatcctgagaaaggggatgccttgtatggctatggagttggccttggctctcgaaaagcttgtaaatgagaagttgcacaacctgcacagtgtggcatcaaggtgcaatgatccacagctgaccgacttcgttgagagtgaattccttgaggagcagtatgtcgcccagctgagaagagtgggaaaggggcatgggggtgtggcactttgatcagaagctgcttgaggaagaagcttgaatggaggagackgtgtgaagggcagtagtaggtttcgtttcttccatccatgggatcatgcagctaaagaaagaaaataagtcgagtctgtgtattcatcaaattaagcacgcagtagcaatggagtga

SEQ ID NO: 252 - protein, 203 aa, Oryza sativa
  misc_feature (5)..(5): Xaa = any naturally occuring amino acid
  misc_feature (34)..(34): Xaa = any naturally occuring amino acid
  misc_feature (56)..(56): Xaa = any naturally occuring amino acid
  misc_feature (84)..(84): Xaa = any naturally occuring amino acid
VFRAXGKGKEVLSGVVFQPFEELKGELSLVPQAXDQSLARQKFVDDCEAAICEQIXVEFNASYAYHSLFAYFDRDNVALKGFAXFFKESSDEERDHAEKLMKYQQNMRGGRVRLQSIVTPLTEFDHPEKGDALYAMELALALEKLVNEKLHNLHSVASRCNDPQLTDFVESEFLEEQYVAQLRRVGKGHGVWHFDQKLLEEEA

SEQ ID NO: 253 - DNA, 315 bp, Oryza sativa
  misc_feature (182)..(182): r = adenine or guanine
  misc_feature (206)..(206): s = guanine or cytosine
atggaggtccacggcgcggcgagcagggagcagcagcagcacgacggcggcggcggcggggtgaaggtgaagttcatcgagacgcagttcgtcagctccgacgcggccagcttcaaggccgtcgtgcagcggctcacgggccagtccgcgccctcgccttcggcgccggcgacctcggctargccgagcaggccgcgcgcgcgccscggcagtcgtgccgtgattgccagtcgccattgttgtgccgatcaacctggacggagctcctctgatgtagagtcagaaggaggaccgactatttgccattgcacataa

SEQ ID NO: 254 - protein, 104 aa, Oryza sativa
MEVHGAASREQQQHDGGGGGVKVKFIETQFVSSDAASFKAVVQRLTGQSAPSPSAPATSATPSRPRARPGSRAVIASRHCCADQPGRSSSDVESEGGPTICHCT

SEQ ID NO: 255 - DNA, 1419 bp, Oryza sativa
atggctggtggctttagggtattgcatcttgtcaggccttttctggctttcctgcctgaagtacagagtgctgataggaaaataccatttagagaaaaagtgatctacactgttatttccctattcattttcctggtatgcagccagctaccactgtatggcatccattcaactactggagctgatcctttctactggatgcgtgttatccttgcatcaaaccgtggtactgttatggagctgggtatcactccaattgtgacatctggcatggtaatgcaacttctagtgggatcaaagatcattgaagttgacaacagtgtgagagaggatcgtgctctgctgaatggcgcacaaaagttacttggtatcctgattgcaattggggaagctgtggcatatgttttgtctggaatgtatggcagtgtaagccagcttggaactggaaatgccatcctcattatacttcagcttttctttgctggcatcattgtcatctgtctggatgaacttctccagaaaggttatggtttgggttctggcatttctctctttattgctaccaatatctggtgagaatatcatctggaaggcatttagccccacaactatcaacagtggccgtggtgctgagttcgagggggctgtcattgcattgttccatctgttgattactagaaccgacaaagtccgtgccttgcgcgaggctttctaccgccagaatcttccaaatgtgaccaacttgcttgctactgttttagtcttcctcatagttatctacttccaaggcttccgtgttgtgctaccagtgagatccaagaatgcccgcggtcaacaaggctcatacccaattaagctgttctacacttcaaacatgcccatcattctgcattctgcactgattaccaacctctatttcatatcccagcagcttctctacaggaggtacagtggaaatttcctagtcaaccttattgggaaatggaaggaatctgagtactctggccattctgttcctgttggtggtcttgcttactatgtaactgctccatcaagagtttagctgatgttctcgcaaatccattccatgcactgttctatgtggtcttcatgctgtcagcttgtgctctcttctcaaagacatggattgaagtatctggttcatcagcaaaggatgttgctaaacagctcaagaggagcaacaaatggtgatgccaggccatcgtgagtcgaatttacagaaagaattgaacagatacatccctacagctgctgcatttggtggagtctgcattggtgcattgactgtcctagctgatttcatgggtgcaattggttcaggaactgggatactgctcgctgttacaatcatctaccagtattttgagacattcgagaaagaaagggctaccgagctag

SEQ ID NO: 256 - protein, 475 aa, Oryza sativa
  misc_feature (336)..(337): Xaa = any naturally occuring amino acid
  misc_feature (401)..(401): Xaa = any naturally occuring amino acid
MAGGFRVLHLVRPFLAFLPEVQSADRKIPFREKVIYTVISLFIFLVCSQLPLYGIHSTTGADPFYWMRVILASNRGTVMELGITPIVTSGMVMQLLVGSKIIEVDNSVREDRALLNGAQKLLGILIAIGEAVAYVLSGMYGSVSQLGTGNAILIILQLFFAGIIVICLDELLQKGYGLGSGISLFIATNIGENIIWKAFSPTTINSGRGAEFEGAVIALFHLLITRTDKVRALREAFYRQNLPNVTNLLATVLVFLIVIYFQGFRVVLPVRSKNARGQQGSYPIKLFYTSNMPIILHSALITNLYFISQQLLYRRYSGNFLVNLIGKWKESEYSGXXHSVPVGGLAYYVTAPSKSLADVLANPFHALFYVVFMLSACALFSKTWIEVSGSSAKDVAKQLKXEQQMVMPGHRESNLQKELNRYIPTAAAFGGVCIGALTVLADFMGAIGSGTGILLAVTIIYQYFETFEKERATEL

SEQ ID NO: 257 - DNA, 1449 bp, Oryza sativa
atgaccggcgccgtctccaagctcgccgccccgaggccggcggccgccgcgccgctcccgccggcgtccgtccgctccgcgttcctcgcctccgccccctccccgcgccgcttctccgtctccatcgccgccggccgcgccaggagccccatcatagtttttagttgtaactcacatgtctcgtttctcatactcatgaattcgacaattttcagtgcgatggcttctgccaaggaaggaaatggtgccccaacgaagaggacaacccttcatgatctctatgatctccagggtcagtccccgtggtacgacaacctctgccgtcctgtcaccgatttgctgccccttattggcagcggcgtccgtggagtcaccagcaacccatcagtacgctacactacttatttcttttgctctcttgcaccttgttctgaatctgcaatcctcattgctgactgtgtccctatggcaatgcagattttccagaaagccatctcgacttccaatgcatacgatgaccagttcaagcagcttatattagctggaaaggacgcagagagcgcttattgggaacttgtcatcaaggatatccaagatgcgtgcaaactttttgagcctatctacgaccagaccgatggggcagatgggtatgtttctgtggaggtctcccctaggctggcaaatgatacccagggaactgttgaagctgcaaaatggttgcacaaagtggtcgacaggcccaatgtctacataaagatccctgctaccgcagaatgtgttccttctatcaaggaagttattgctaatggcattagtgtcaacgtcacacttatcttctcgattgcaagatacgaggctgtgattgatgcttacattgatggacttgaggcctctggtttgagtgacctatcccgagtgaccagtgtagcgtccttctttgtcagccgagttgacacacttattgacaaaatgctcgagaagatcggaacacctgaggcacttgccctcagaggaaaggctgctgtagcacaggcaaagctagccaaccagctttaccagaagaaattctctggcccgaggtgggaggctttggtcaagaaaggtgccaagaagcagaggttgttgtgggcatctaccagtgtgaagaaccctgcatacccagacactctttacgtggatcctctcatcggacctgacaccgtttctaccatgcccgaccaagctctgctggcattcatcgaccacggcacagtttcgaggacaatcgacgcaaacgtttcggatgctgaaggtgtatacagtgccctggagaagctgggtatagattgggatgaggttggcaagcagctagagctggaaggtgtggactccttcaagaaggccttcgacagcctgcttgggagcttggaggagaagggcaattccctcaagaagaccgtgagcctgtag

SEQ ID NO: 258 - protein, 482 aa, Oryza sativa
MTGAVSKLAAPRPAAAAPLPPASVRSAFLASAPSPRRFSVSIAAGRARSPIIVFSCNSHVSFLILMNSTIFSAMASAKEGNGAPTKRTTLHDLYDLQGQSPWYDNLCRPVTDLLPLIGSGVRGVTSNPSVRYTTYFFCSLAPCSESAILIADCVPMAMQIFQKAISTSNAYDDQFKQLILAGKDAESAYWELVIKDIQDACKLFEPIYDQTDGADGYVSVEVSPRLANDTQGTVEAAKWLHKVVDRPNVYIKIPATAECVPSIKEVIANGISVNVTLIFSIARYEAVIDAYIDGLEASGLSDLSRVTSVASFFVSRVDTLIDKMLEKIGTPEALALRGKAAVAQAKLANQLYQKKFSGPRWEALVKKGAKKQRLLWASTSVKNPAYPDTLYVDPLIGPDTVSTMPDQALLAFIDHGTVSRTIDANVSDAEGVYSALEKLGIDWDEVGKQLELEGVDSFKKAFDSLLGSLEEKGNSLKKTVSL

SEQ ID NO: 259 - DNA, 1980 bp, Oryza sativa
  misc_feature (11)..(11): m = adenine or cytosine
  misc_feature (1374)..(1374): r = adenine or guanine
  misc_feature (1450)..(1450): k = guanine or thymine
  misc_feature (1629)..(1629): y = cytosine or thymine
  misc_feature (1652)..(1652): r = adenine or guanine
  misc_feature (1740)..(1740): k = guanine or thymine
atggagcccamcggcacgatcgtcttcgccaccgtcggcgtcaccaacttcggcttcgacgtcttctccgccgccgtgccactgccgccgatggaggaggacgccgagcgccgccacacggacggcgtatccgtgaacttcaacgcgcagttcgtcgacgatggcggggaggaggtggcgttcgtgtcggagcgaggcggcgcggcggggctgttccggtgccggccggggcccgagcagcgggccgagccgctgccgacggtggaggggagcctgttccatgaccgcccgacggtgaggggcgggaggttgtacttcgtctccgcccacgagcagccgccggcgccgttcaggagctgggcggcggtgtacgcgacggagattgggagcaaggagacggtgcgggtgagtcctccgggcgtcgtggacatgagccccgccgtgtcggactccggggagctcgttgccgtcgcgtcgtacggggatcggccgtgggcgttcgacttccgcgtgctggaaacggaggtcgccgtcttccgcgccgccgatccagccaggcgcgtcgtcgtggtggggcgcggtgggtggccgacgtggcacggcgagggcacggtcttcttccaccgcgtcgccgacgacgggtggtggagcgtgttccgggtggacgtctcgcctgagaccctcgagcccaccggcggcgagaggcgagtgacgcctcccgggctgcactgcttcactcccgccgcggtcggccgcggcggcggcgggcggtggatcgccgtggcgacgcggcggaaggggcgcgcgcagcggcacgtcgagctgttcgacctcgagacggagagcttctccccgctcaccgagcgcctcaacccggagctccaccactacaaccccttcttctccccgtccggcgaccgcgtcgggtaccaccgcttccgcggcgccggcgcgcggggggactcggtggtgccctacctgcagccggtgcagagcccggtgagctcgctccggatgctgcgcgtgtacggcacgttcccgtcgttctcgccggacgcggcgcacctcgccatgaacggcgacttcttcaagacgccgggcgtcaccatcctccgatccgacggcgccaagcggtgggtgctcacgcgggagcccaacctgttctacacgtcgtggagccccgccgagagcggggtcatcttcacctccatgggccccatcttcgagaccaccaaagcgacggtgaggatcgcgcggctggagttcgacgccggcgagctcaccaccggccgcgacgaggtcgcggccacgctcaaggtgctcacccggccggaggccggcaacgacgcgttcccggcggtttcgccgtgcggraagtgggtggtgttccggtcaggccgctccggccacaagaacctctacatcgtcgacgcggcgcacggcgaggacktcggcgccggcgaggggacgatccggcggctgaccgacggcgagtggatcgacacgatgccgagctggtcgccggacgggagcctgatcgcgttctcctccaaccgccacgacccgacgaacgccgccgtgttcagcatctacctggtccggccagacggctccgggctccgccgcgtycacgtcgccgggccggcggggarcgcggcggcggacagggagcggatcaaccacgtgtgcttcagcccggactcgcggtggctgctgttcacggccaacttcggcggcgtkatggcggagcccatctcggcgccgaaccagttccagccgtacggcgacctgtacgtgtgccggctcgacggctcggggttggtcaggctcacctgcaacgcctacgagaacggcacgccggcgtggggcccggcgagctcgccggcggcggggctggagtcgctgtcgctgggcccgggcgccggggacgagtcgctgggcgagtttgatgagccgctctggctcacttgcgacgtctga

SEQ ID NO: 260 - protein, 659 aa, Oryza sativa
MEPNGTIVFATVGVTNFGFDVFSAAVPLPPMEEDAERRHTDGVSVNFNAQFVDDGGEEVAFVSERGGAAGLFRCRPGPEQRAEPLPTVEGSLFHDRPTVRGGRLYFVSAHEQPPAPFRSWAAVYATEIGSKETVRVSPPGVVDMSPAVSDSGELVAVASYGDRPWAFDFRVLETEVAVFRAADPARRVVVVGRGGWPTWHGEGTVFFHRVADDGWWSVFRVDVSPETLEPTGGERRVTPPGLHCFTPAAVGRGGGGRWIAVATRRKGRAQRHVELFDLETESFSPLTERLNPELHHYNPFFSPSGDRVGYHRFRGAGARGDSVVPYLQPVQSPVSSLRMLRVYGTFPSFSPDAAHLAMNGDFFKTPGVTILRSDGAKRWVLTREPNLFYTSWSPAESGVIFTSMGPIFETTKATVRIARLEFDAGELTTGRDEVAATLKVLTRPEAGNDAFPAVSPCGKWVVFRSGRSGHKNLYIVDAAHGEDLGAGEGTIRRLTDGEWIDTMPSWSPDGSLIAFSSNRHDPTNAAVFSIYLVRPDGSGLRRVHVAGPAGTAAADRERINHVCFSPDSRWLLFTANFGGVMAEPISAPNQFQPYGDLYVCRLDGSGLVRLTCNAYENGTPAWGPASSPAAGLESLSLGPGAGDESLGEFDEPLWLTCDV

SEQ ID NO: 261 - DNA, 207 bp, Oryza sativa
atggccattgagatcattcttgtcactagtcagctcaaggagtccttccggtgtgattttggtggtgccatcgatagtgaggtttttgccggtgaaaccatggtagatgaattggttttgaccggcacaaagggctataaggttgaagccaagcgacacaaggagcagaaagaagggaggatgctccatgtcacagaaaagtactag

SEQ ID NO: 262 - protein, 68 aa, Oryza sativa
MAIEIILVTSQLKESFRCDFGGAIDSEVFAGETMVDELVLTGTKGYKVEAKRHKEQKEGRMLHVTEKY

SEQ ID NO: 263 - DNA, 832 bp, Oryza sativa
atggccgtaggtaagaacaagcgcatctccaaggggaagaagggatccaagaagaagaccgtcgatccctttgctaagaaggactggtatgatatcaaggccccgtcggtgttcaatgtgcggaacatcggcaagaccctcgtgtccaggacacagggtacaaagagattgcttctgagggcctaaagcatagagtgtttgaggtctccttagctgatctccagaacgatgaggatcaggcgtacaggaagatcagacttcgtgctgaggatgtgcaagggaagaacgtgctcaccaacttttgggggcatgtcgtttactaccgataagctcagatcacttgttaagaagtggcagacactgattgaggctcatgtggatgtcaaaaccacagacggctacatgctgcgtctgttctgtatcggcttcaccaagcggcggcctaaccaggtgaagaggacttgctatgctcaagcgagtcagatcagacagcagattcgtcgcaagatggttgaaatcatggccaaccaggcttcaagctgtgatttgaaagagctagtttcaaagttcattcctgaagttattgggaaggaaattgagaaggcgacatccagtattttcccccttcagaatgtgtttgtccgcaaagtgaagattctaaaggccccgaaatttgacctggggaagctcatggagcaggtgcatggtgactatgccaaggaggacatcggtacgaagcttgataggcctgcagaagatgaggccatggccgggcaggaggtcgctgctgccgagtagagattatcacttattttgctgcccgtttatttag

SEQ ID NO: 264 - protein, 265 aa, Oryza sativa
  misc_feature (56)..(56): Xaa = any naturally occuring amino acid
MAVGKNKRISKGKKGSKKKTVDPFAKKDWYDIKAPSVFNVRNIGKTLVSRTQGTKXIASEGLKHRVFEVSLADLQNDEDQAYRKIRLRAEDVQGKNVLTNFWGMSFTTDKLRSLVKKWQTLIEAHVDVKTTDGYMLRLFCIGFTKRRPNQVKRTCYAQASQIRQQIRRKMVEIMANQASSCDLKELVSKFIPEVIGKEIEKATSSIFPLQNVFVRKVKILKAPKFDLGKLMEQVHGDYAKEDIGTKLDRPAEDEAMAGQEVAAAE

SEQ ID NO: 265 - DNA, 147 bp, Oryza sativa
atggaacggcacaagaagatgatgatgacgatgcaagtcgcccaccgagatcggccgccatttgcctatgccgccggcgagaagctcgccgaggcgccactgccctgcctcctcagcgccaagccactgacgaatgaccccacctaa

SEQ ID NO: 266 - protein, 48 aa, Oryza sativa
MERHKKMMMTMQVAHRDRPPFAYAAGEKLAEAPLPCLLSAKPLTNDPT

SEQ ID NO: 267 - DNA, 1095 bp, Oryza sativa
  misc_feature (163)..(163): r = adenine or guanine
  misc_feature (166)..(166): k = guanine or thymine
  misc_feature (194)..(194): k = guanine or thymine
atgtggcgcgcggccgcctaccacctcctcctcctccgccgcgccgcgcatcctcctccctctccggcaaccgccacaggggcggcctgcgcgctccgccacgtgcgcctcttctccccgcctccgcatccgccgtcgtcgcggcccacggaggccaaggcgragkttacggcggcgaaggctccgaaggcttkttccggctggtgggccttgaggcgctctaagcggcggctgagggacgggcgggaggaggtggtcgggtacggggagctcctggacgcctgcgtcgaggccggcgcggcgcgcacgcggcgtgacgcggaaggcgctggcccggggccatggacgaggccggcgtcgtgctgctgttccgcgacaaggcctacctccaccccgagaagcccattggagattcaaatgctcctatataagcacccattttctctgacctgcaatgttagtagtgttcctgaaatggataatcgaaatggacatgcacaattcaagttgatcgaattggataccaacaaaataacaacaaatgaagttttgttcaaagtggttgagcttgttagaagagctgttccgcttgcactctcaccggagaacgattcaagaaaagaagagctgaagaagctccaggagaagaaggaagagatcgacaagctggcgcacaagcaagtccggcgcatcctgtggtctggactaggtttcttcatgtgccaagttgggctcttcttccgccttactttctgggaattttcatgggatgtgatggagccaattgccttcttcacaactgcatctggcctgctcgttggttacgcatatttcctcattacctcaagggatccaacatatgaggacttcatggaaaggttgtatttgtcaagacacagaaagctttgtgccaagaatagttttgatatggcaaagtacctcgagttgcagaagcattgcaagtgtcctctggaaggacataaagatgccattttgatgccaaagagcaaaacaaacatcgtttttctgcctataaagatgtcaacgcaccgaaaaatagccaggcttgccattggtaaagaattggatgaataa

SEQ ID NO: 268 - protein, 364 aa, Oryza sativa
MWRAAAYHLLLLRRAAHPPPSPATATGAACALRHVRLFSPPPHPPSSRPTEAKAQLTAAKAPKASSGWWALRRSKRRLRDGREEVVGYGELLDACVEAGAARTRRDAEGAGPGPWTRPASCCCSATRPTSTPRSPLEIQMLLYKHPFSLTCNVSSVPEMDNRNGHAQFKLIELDTNKITTNEVLFKVVELVRRAVPLALSPENDSRKEELKKLQEKKEEIDKLAHKQVRRILWSGLGFFMCQVGLFFRLTFWEFSWDVMEPIAFFTTASGLLVGYAYFLITSRDPTYEDFMERLYLSRHRKLCAKNSFDMAKYLELQKHCKCPLEGHKDAILMPKSKTNIVFLPIKMSTHRKIARLAIGKELDE

SEQ ID NO: 269 - DNA, 192 bp, Oryza sativa
atggccgccgctcctgggaccaccgaatgggtgtgcagccagattcaccgcctccagaacccaccaccacctcgggctaccatgcatggggacgacaccggcgaccttgtgctaaacgggacagagcccgaactacgggaaagaccagaaaacggaagggacccgactcacactaggctaggaggaggctag

SEQ ID NO: 270 - protein, 63 aa, Oryza sativa
MAAAPGTTEWVCSQIHRLQNPPPPRATMHGDDTGDLVLNGTEPELRERPENGRDPTHTRLGGG

SEQ ID NO: 271 - DNA, 897 bp, Oryza sativa
atggagttcgaagaccgctgccacaaggtccaggagcccaaattcgactgcctgctgtttgacctcgatgacactctgtacccactgagctcggggatcgcgtcccatgtcaagaagaacattggagattacatggttgagaagctgggtattgaggagagcaagattgagaaccttggcaatctgctgtacaagaactacggcacgacgatggccggactcagggcaataggctacagcttcgattacgatgagtaccacagttttgtccatggaagactgccctacgagaacatcaagccggaccctgtcctgaagcacattctcaagaacctgcgcatccgcaaactcgtgagttcctccagaccagaatcgaaaccaatctcacatgtctcatatattcaccaacggcgacaaggaccacgccgtgagagccctcaagaggctgggctggaggactgcttcgaggggatcatctgcttcgagaccctcaacccgccgtgcccgtcgccgccgtgcgacggggaggccagcatcttcgacatcgccggacacttctccatgcccggcgccgccgccgacgagcttcccaggacacccgtcctctgcaagcccaacgtcgacgccatggaggaggccctcaggatcgccaacgtgaaccctcacaaggcgattttcttcgacgacagcgtgaggaacatccaggcggggaagaggatcgggctccacacggtgctggtgggcacgccgcagcgggtgaagggcgcggaccacgcgctggagagcatccacaacatcagggaggcgctgccggagctgtgggaggaggccgagaaggcggaggacgtgctcatctactccgaccgcgtcgccatcgagacatcggtgaccgcgtag

SEQ ID NO: 272 - protein, 298 aa, Oryza sativa
MEFEDRCHKVQEPKFDCLLFDLDDTLYPLSSGIASHVKKNIGDYMVEKLGIEESKIENLGNLLYKNYGTTMAGLRAIGYSFDYDEYHSFVHGRLPYENIKPDPVLKHILKNLRIRKLVSSSRPESKPISHVSYIHQRRQGPRRESPQEAGLEDCFEGIICFETLNPPCPSPPCDGEASIFDIAGHFSMPGAAADELPRTPVLCKPNVDAMEEALRIANVNPHKAIFFDDSVRNIQAGKRIGLHTVLVGTPQRVKGADHALESIHNIREALPELWEEAEKAEDVLIYSDRVAIETSVTA

SEQ ID NO: 273 - DNA, 646 bp, Oryza sativa
atggcgccgacgtcgaagctgtcgcagggcatcaagcgcgcgtcgcggtcgcacacctaccaccgccgcgggctctgggccatcaaggccaagaacggcggcaccttccccaaggccggcaagcccgccgccgccgccgagcccaagttctaccccgccgacgacgtcaagccccgcgcccccagcacccgcaaggccaaccctaccaagctcaggatcacgccggggacggtgctgatcctgctcgccgggaggtacatggggaagcgcgtcgtgttcctcaagcagctcaagtccggcctgctcctcatcaccgtcaggaccttttaagatcaatggagtgcccatccgccgtgtgaaccaggcctacgtcattgccacatccacgaaggttgacatctctggtgttaaggtggataagtttgatgacaagtactttgcccgggacaagaaggcaaaggccaagaagaccgagggtgaactttttgagacagagaaggagctgcccgacttcaagaaggatgaccagaaggctgtggatgctgagttgatcaaggctatcgaggttgtcccagacctgaaatcctatcttggtgcccggttctctctcagggacggcgacaagccccatgagatgacattctaa

SEQ ID NO: 274 - protein, 214 aa, Oryza sativa
MAPTSKLSQGIKRASRSHTYHRRGLWAIKAKNGGTFPKAGKPAAAAEPKFYPADDVKPRAPSTRKANPTKLRITPGTVLILLAGRYMGKRVVFLKQLKSGLLLITSGPFKINGVPIRRVNQAYVIATSTKVDISGVKVDKFDDKYFARDKKAKAKKTEGELFETEKELPDFKKDDQKAVDAELIKAIEVVPDLKSYLGARFSLRDGDKPHEMTF

SEQ ID NO: 275 - DNA, 992 bp, Oryza sativa
  misc_feature (387)..(387): s = guanine or cytosine
  misc_feature (438)..(438): r = adenine or guanine
  misc_feature (460)..(460): k = guanine or thymine
  misc_feature (482)..(482): s = guanine or cytosine
  misc_feature (517)..(517): s = guanine or cytosine
  misc_feature (549)..(549): y = cytosine or thymine
atggcgagcgccggcggtgaggtcgtcgtcgtcgacccggccgcggccgcggtggcgcctgacgtcgagcaccacgcgccggcgccgcggctgactccggcgggcagcggcgggcggctgatggcggagctgctcggcgtgttcaacgggctgacggagcggatgggggacgacgtcgccacctcgtcgtcgtggaccctcctcttccgcgcgctcaagctggcgctgcccgcgctccgcgacgccgccggcggacgctccctcgcccgcgcgctcatcgtcgcggcgtccctcgccgacctccagatggacgccgaggtcatctcggcggggatcgtgaggcaggcgatggacgccggcgcggtggccatggccgacgccgaggcscagctcgggccgggcgccgccgcgctgctcctcgagagcctcgacgttaaraacgcgccgttgcgggtcgacktcgccgacgaggaggcggcaascccgtcccaaccggatctctctggctacgacttcsgcgccgtcatcctcgagctcgccatcaggctygacgccatgaagcacctcgacggcgtccccaagcaccagcagcgcacaacttgctggaggtgctcaaggcgaaaaggctcaaggacatcatgctggcggcggcagaggttgcagcgcagcacctccgcgacgagccagccaccggcgaccagcgagcattccggttgctggacaagaacggcgacgggaggatcagcatggaggagctgacggagctcatggaggacctcggcgccggcggcaaggacgccgaggagctcatgcgcctcctcgacgacaataacgacggctcgctcagctccgacgagttcgccctcttccaattggaggacaaggatgatgagtacaaggagatcctcaggcagaagctgcagaaggtcgacgacacggggctcatccacgtctaccgcaagaacctcagcgacaagctcgtctccggctga

SEQ ID NO: 276 - protein, 252 aa, Oryza sativa
  misc_feature (16)..(16): Xaa = any naturally occuring amino acid
  misc_feature (33)..(33): Xaa = any naturally occuring amino acid
  misc_feature (48)..(48): Xaa = any naturally occuring amino acid
  misc_feature (70)..(70): Xaa = any naturally occuring amino acid
  misc_feature (73)..(73): Xaa = any naturally occuring amino acid
  misc_feature (92)..(92): Xaa = any naturally occuring amino acid
  misc_feature (140)..(140): Xaa = any naturally occuring amino acid
GRRWTPARWPWPTPRXSSGRAPPRCSSRASTLXTRRCGSTSPTRRRQXRPNRISLATTSAPSSSSSPSGXTPXSTSTASPSTSSAQLAGGAXRRKGSRTSCWRRQRLQRSTSATSQPPATSEHSGCWTRTATGGSAWRSXRSSWRTSAPAARTPRSSCASSTTITTARSAPTSSPSSNWRTRMMSTRRSSGRSCRRSTTRGSSTSTARTSATSSSPAQRLQRSTSATSQPPATSEHSGCWTRTATGGSAWRS

SEQ ID NO: 277 - DNA, 3316 bp, Oryza sativa
  misc_feature (462)..(462): r = adenine or guanine
  misc_feature (472)..(472): r = adenine or guanine
  misc_feature (481)..(481): r = adenine or guanine
atggccgccgccgccgaggtggagtccttcctggcgacgtgcgcggcctccggcgacgcggcgtacggcgcagccaaggccgtgctcgagcgcctccaggaccccgcctcccgccccgacgcccgccgcctcctcggcgccgtccgccgccgcttcgccggccccgccgccggggaggaatgcttccgcaccttccacttccgcatccacgacgtcgtcctcgatccccacctccgagggattccagcagaggaagaagctaacgatgatggaaatacctagcattttcattcctgaagactggtccttcactttctatgagggcctcaatcggcatccagattccattttcagggataagacagtagctgagctgggatgtggcaatggttggatatccattgcacttgcagaaaagtggtccccttcgaagaaggtctatggactggatataaacccaaragctgtcaarattgcatgrataaacctttacttgaatgcactagatgacgatggtctcccaatctacgacggggaggggaaaacattgctggatagagtagaattctatgaatctgatcttctctcttactgcagagacaataaaattgaacttgatcgcattgttggatgcataccacagcagattcttaacccaaatccagaagcaatgtcaaagatcgtaactgaaaattccagtgaggagttcttgtattcattgagtaactactgtgctcttcagtattgcatccagggttttgttgaggaccaatttggccttgggttgattgctcgggctgttgaagaagggatatcagtcataaagcctatgggtattatgatatttaacatgggtggtcgaccaggacaaggtgtctgcgaacgactatttcgacgccgtggatttcggatcacaaaactgtggcaaacaaaaattatgcagtgcaggctgctgacacagatatttcagctttagtggaaattgagaaaaatagccggcatcgctttgagtttttcatggatcttgttggggatcagcctgtctgtgcacgcacagcttgggcatacatgaaatctggtggtcgtatttcacatgctttgtcagtgtatagctgtcaacttcgccaacccaaccaggttccttgtgtattctttagatttctaaaagcaatcaggtgaagaaaatatttgagtttcttaaagatgggttccatgaagtcagcagctccctggatttgtcttttgatgatgattctgttgctgacgaaaaaatacccttcctagcatacctagctagttttttgaaggagaataaatacaatccttgtgaaccaccagctggttgtctaaacttccggaatcttgttgctggatttatgaagagctaccaccatatcccattaactcctgataatgttgttgttttcccttcccgtgctgtggcaatagaaaatgctcttcgattattctcaccagcgcttgcgatcgttgatgaacatctgaccagacacttgccaaagcaatggttaacttctttagcaattgagtacagttactgtaattgaggcaccacgccaatctgatttgttgattgagttgatcaggaaactgaagcctcaggtggttgttactggcatggctcagtttgaggctatcacaagtgctgcttttgagaacttattaagtgtaacgaaggatgttggttctcggttattcatcgatatttcagagcatctggagttgtctagtttgccaagctctaatggtgtattaaaataccttgctggaaagaccctaccttcccatgcagctatactatgcggtttagtaaagaatcaggtgcctcaggtttattctgatctggaggttgcttttgccatttctgaagatgcagctgtttatagggcattatcacaaactattgagctattggaagggcatacgtctcagatcagccagcactattatggttgtcttttccatgagctactggcatttcaaattgctgatcggcatccacaacaagaaagactgcctgcagaagtgatacctcagaagatgataggattttcaagttcagctatgtctaccctaaaagaagctgaatttttcattcctgactccaaaaaatccagtgtcattcatatggatttagatcgcagcttcttgccagtgccttctgcagtgaatgcctccatttttgaaagttttgttaggcagaacattactgagtctgaaactgatgtccgttccagcattcagcagctggtgaaagatagctatggtttcccagcagatggttgttctgaaatattatatggcaacacctgtcttgcactcttcaacaagcttgccctttgctgcatccaagaccagggcaccttacttttccccttgggcgctaatggtcactatgtctcagcagcaaagtttgtgaatgcaaatacgctgactattccgacaaagttagaatcaggcttcaagattgaaccacgggttctagctgacacacttgagacagtatctaggccatgggtttatatttctggccccacaattaaccctactggtttcctgtacagtgacagtgatattcaagagctcctttctgtttgtggtaaatatggagctagggtagtaatagatacctccttctctggtctggaattccaaactgatggctggagtcgatggaatttggaaagatgtctttctgctgtgaattgtccaaaaccctcgttctctgtagctcttctcggagaactgtcctttgagctgactgctgcagggcatgactttgggtttctgattttgaatgactcatccttggttgacacatttcacagtttcccaagcttgagtcgtccccacagtacgctgaagtacactttcaaaaaactactgggcctcaagaatcagaaggatgaacacttctccaatctcattatggagcagaaggacacactaaagagtcgtgctgaccacttgataaagacagacacttgagggctgtggctgggatgttgctggcagtcatggtggcatatcgatgctggcgaaaccgactgcctacatcggcaaaataatcaaggtggatggttttgatggcaagctagatggctgcaacatcaaggaagccattctcaggtccaccgggttgtgcataaacagcagctcatggacaggaataccggatcactgtcggttcagctttgctctggagagcagcgaattcgagcgtgcaatgggctgcatagttcgcttcaaggagttggttcttggaagcaaggcttttcatcagatcaatggtaactaa

SEQ ID NO: 278 - protein, 159 aa, Oryza sativa
  misc_feature (154)..(154): Xaa = any naturally occuring amino acid
WPPPPRWSPSWRRARPPATRRTAQPRPCSSASRTPPPAPTPAASSAPSAAASPAPPPGRNASAPSTSASTTSSSIPTSEGFQQRKKLTMMEIPSIFIPEDWSFTFYEGLNRHPDSIFRDKTVAELGCGNGWISIALAEKWSPSKKVYGLDINPXAVKIA

SEQ ID NO: 279 - DNA, 1023 bp, Oryza sativa
  misc_feature (102)..(102): k = guanine or thymine
  misc_feature (650)..(650): r = adenine or guanine
atgtcgacgccgagagcggcggcgagcctcgccaagaaggcggcgctggtggcgctggccgtcctggccgcggcgctcgcgacggcggcgcgcgccgagcaktgcggcgcgcaggccggcggcgccaggtgcccgaactgcctctgctgcagccgctggggctggtgcggcaccacctccgacttctgcggcgacggctgccagagccagtgcagcggctgcggcccgacgccgacgccgacgccgccgagcccctccgacggcgtgggctccatcgtgcccagggacctgttcgagcggctcctcctccaccgcaacgacggggcgtgccccgcgcgcgggttctacacctacgaggccttcctcgccgccgccgccgcgttcccggcgttcggcggcaccggcaacaccgagacgcggaagcgggaggtcgccgcgttcctgggccagacctcccacgagaccaccggcgggtggccgaccgcgcccgacggccccttctcctggggctactgcttcaagcaggagcagaacccgccgtccgactactgccagccctcgccggagtggccgtgcgcccccggccgcaagtactacggccgcggccccatccaactctccttcaacttcaactacgggccggcggggarggcgatcggggtggacctgctgagcaacccggacctggtggcgacggacgcgacggtgtcgttcaagacggcgctgtggttctggatgacgccgcaggggaacaagccgtcgagccacgacgtgatcacggggcggtgggcgccctcgccggccgacgccgcggcggggcgggcgccggggtacggcgtgatcaccaacatcgtcaacggcgggctggagtgcgggcacggccccgacgaccgcgtggcgaaccggatcggcttctaccagcgctactgtggcgcgttcggcatcggcaccggcggcaacctcgactgctacaaccagaggccgttcaacagcggctcgtcggttgggttggcggagcagtga

SEQ ID NO: 280 - protein, 340 aa, Oryza sativa
MSTPRAAASLAKKAALVALAVLAAALATAARAEHCGAQAGGARCPNCLCCSRWGWCGTTSDFCGDGCQSQCSGCGPTPTPTPPSPSDGVGSIVPRDLFERLLLHRNDGACPARGFYTYEAFLAAAAAFPAFGGTGNTETRKREVAAFLGQTSHETTGGWPTAPDGPFSWGYCFKQEQNPPSDYCQPSPEWPCAPGRKYYGRGPIQLSFNFNYGPAGRAIGVDLLSNPDLVATDATVSFKTALWFWMTPQGNKPSSHDVITGRWAPSPADAAAGRAPGYGVITNIVNGGLECGHGPDDRVANRIGFYQRYCGAFGIGTGGNLDCYNQRPFNSGSSVGLAEQ

SEQ ID NO: 281 - DNA, 906 bp, Oryza sativa
atgggagggtttgtcaagacccagaagacccatgcctacttcaagcgattccaagtcaagttcaagagacggaggcagggcaagactgactacagggccaggattaggctcaccaaccaagataagaacaagtacaacacaccgaagtaccgcttcgttacaaacaaagatatcacagctcaaattgtctatgctaccattgcgggtgatatcgtgatggctgctgcctactcccatgagctgcctcgttatggtcttgaagttggtctcaccaactatgcggcagcttactgcactggcttgcttctggctcgtcgtgtgctcacgctccgtggtttggaccaggagtacgagggcaatgttgaggccactggggaggactactatgttgaaccagctgatgaaaggaggcctttccgtgctctcttggatgttggcctcattaggacaaccactggaaaccgtgtctttggtgccctcaagggagctttggatggtggtcttgacattcctcacagtgacaagaggtttgctgggttcaagaaggacgagaagcagcttgattctgatattcaccgcaagtacatctacggtgggcacgtggctgactacatgaggtctatggctgaggaggaacctgagaaattccaagcccactttagtgagtacctcaagaagggaattgacgctgatggcatggaatcactgtacaagaaggtccatgctgccatccgcgccgatcctaccatggccaaatcgaccaagaaggaaccggctacccacaagagatacaacctcaagaagctgacctacgagcagaggaaggccagtctcgtcgaaagattgaatgctctcaactcctccgctggtgctgatgatgatgacgaggaagaggatgacgagtga

SEQ ID NO: 282 - protein, 301 aa, Oryza sativa
MGGFVKTQKTHAYFKRFQVKFKRRRQGKTDYRARIRLTNQDKNKYNTPKYRFVTNKDITAQIVYATIAGDIVMAAAYSHELPRYGLEVGLTNYAAAYCTGLLLARRVLTLRGLDQEYEGNVEATGEDYYVEPADERRPFRALLDVGLIRTTTGNRVFGALKGALDGGLDIPHSDKRFAGFKKDEKQLDSDIHRKYIYGGHVADYMRSMAEEEPEKFQAHFSEYLKKGIDADGMESLYKKVHAAIRADPTMAKSTKKEPATHKRYNLKKLTYEQRKASLVERLNALNSSAGADDDDEEEDDE

SEQ ID NO: 283 - DNA, 915 bp, Oryza sativa
  misc_feature (175)..(175): r = adenine or guanine
  misc_feature (594)..(594): k = guanine or thymine
atgggagggtttgtcaagacccagaagaccaatgcctaccacaagcgtttccaagtcaagttcaagagacggaggcgtaagtcaagttcaagagaccgaggcgtttccaagtcaagtcaaggttttgacagggcaagactgactacagggccaggattaggctcaccaaccaagrataagaacaagacaaacaaagatatcacagctcaaattgtctatgctaccattgctggtgatatcgtgatggctgctgcctactcccatgagctgcctcgctatggtcttgaagttggtctcaccaactatgcggcagcttattgcactggcttgcttttggctcgccgtgtgctcaagctccgtggtttggaccaggagtacgagggcaatattgaggccactggggaggactactatgttgaaccagctgatgaaaggcggcctttccgtgctctcttggatgttggcctcattaggacaaccactggaaaccgtgtctttggtgccctcaagggagctttggatggtggtcttgacattcctcacagtgacaagaggtttgctgggttcaagaaggacgagaagcagcttgattckgatattcaccgcaagtacatctacggtgggcactctatggcggaggaggaacctgagaaattccaagcccacttcagtgagtacctcaagaagggaattgatgctgatggcatggaagcactgtacaagaaggtccatgctgccatccgtgctgatcctaccatggccaaatcaaccaagaaggaaccggcgacccacaagagatacaacctcaagaagctaacctacgaacagaggaaggccagtcttgtcgaaagattgaatgctctcaactcctctgctggtgctgatgatgatgacgaggaagaggatgatgagtga

SEQ ID NO: 284 - protein, 304 aa, Oryza sativa
MGGFVKTQKTNAYHKRFQVKFKRRRRKSSSRDRGVSKSSQGFDRARLTTGPGLGSPTKHKNKTNKDITAQIVYATIAGDIVMAAAYSHELPRYGLEVGLTNYAAAYCTGLLLARRVLKLRGLDQEYEGNIEATGEDYYVEPADERRPFRALLDVGLIRTTTGNRVFGALKGALDGGLDIPHSDKRFAGFKKDEKQLDSDIHRKYIYGGHSMAEEEPEKFQAHFSEYLKKGIDADGMEALYKKVHAAIRADPTMAKSTKKEPATHKRYNLKKLTYEQRKASLVERLNALNSSAGADDDDEEEDDE

SEQ ID NO: 285 - DNA, 2337 bp, Oryza sativa
atgctggttcagctgcatgatctgcttgagaaggctgactcgaacataattggtatttggggtcaagggggtattggtaagacgacactactacatgccttcaacaatgatcttgagaagaaggtccataactaccagcaggttgtcatatttattgaagtatccaattcagagacacttgacacattggagatgcagaagaccatctccgaacgtcttaatttaccatggaatgaagcagagataactgtgaaacgggccagattccttgttaaggccttgtccaggaaaagatttgtactgcttcttgatgatgtaaggaagaaattccggctagaagatgttggcatcccaactccagacaccaacagccagagcaagctgatcctaacttcacgtttccaagaagtatgctaccagatgggcgcatagaggaacttgattaagatggatcttctggataatgatgctgcatggaaactgttcttgagcaagctaagcaccgaggcttgtgcagcagttgaatcacctagtcccagcaatgttgttagggatcatgccatagcaatagctcaaagttgtggaggtctaccacttgcgctcaatgtcattgggactgctgtggcaggctatgaagaaccaagagattggaattcagctgctgatgcaatcaaagagaatatgaagtttgaaggtgttgatgaaatgtttgctacgctgaaatacagcttcgacaggctcacacctactcagcaacagtgctttctgtattgcactctttttccagagtatggatcaattagtaaagagcatcttgttgattattggttggctgaaggtttgctacttgatgatcgcgagaagggtaatcagataatccgaagtcttatttcagcatgcttgttgcagaccactagttcaatgtcatcaaaggtgaaaatgcaccacataatcagacatttggggctttggttggttaacagggaagatagaagttttgttgttaaagcagggatggccttagataatgctccaccagcaatagaatggaaagaagctacaaggatctccatcatgtctaataacatcacagagctttctttctcaccaaaatgcgaaaacctcaccacactgttaatccagaataacccaaagttgaacaagctaggctggggttttttcaaatatatgcgatccttgaaagtgctagatctatcacacactgcaattacttccattccagaatgtgataaattggttgcattgcagcatctcgacctgtcatacacacatattatgagattacctgagcgcctatggttattgaaagagttgaggcatctggacctcagtgtgactgttgcacttgaagatactttgaataactgctcaaagttacacaagttgagagtgctgaatctcttccgcagccattacgggattcgtgatgttgatgacctgaatctggattcactgagggatctattgtttcttggtatcactatttattcacaagatgtgcttaagaaattgaacgagacccatcctttggcaaaatcaacgcatcgcttgaacctgaagtattgtggagatatgcaatcaatcaaaatttctgactttaaccatatgaagcaccttgaggagctgcatgtcgaatcatgctatgacctgaatacactggttgccgatactgagttgacgacttcttgcctacaagcactgaccctctccgtccttccctcattagaaaatgtccttgttgcaccaatgccccataattttcggtacgttcgcaaattgtccatttcacaatgccccaagttgttgaacatcacatgggtccgaagacttgaactgcttgagaggcttgtcatatccaattgtgatgagatgctgactattgttgaagaagctaacagtactgaagagcagcaatatggaacacaaacaataaaaatgcagggttattattctgaagaacaagacgatcatgcaatggctgagagttcacgcaatgagtggaatgatgattaccaaagcgtcaatggagaatcaaccaatggcgcaacgaggcaacctgacttcccaaagttgagatcaattgtgctgactgatgtgaagaagctgagaagcatttgcacgccaagagattttccctgccttgagactcttcgagtggaagactgcccaaatttgagacgcatcccactgtgcagcactcacaactgtggtaaactgaagcaaatttgtggttcatctgattggtggaagaaactgctgtgggaggacaaggaggcggtggcacatatggagagcaagtacttcattccaatctga

SEQ ID NO: 286 - protein, 778 aa, Oryza sativa
  misc_feature (144)..(144): Xaa = any naturally occuring amino acid
MLVQLHDLLEKADSNIIGIWGQGGIGKTTLLHAFNNDLEKKVHNYQQVVIFIEVSNSETLDTLEMQKTISERLNLPWNEAEITVKRARFLVKALSRKRFVLLLDDVRKKFRLEDVGIPTPDTNSQSKLILTSRFQEVCYQMGAXRNLIKMDLLDNDAAWKLFLSKLSTEACAAVESPSPSNVVRDHAIAIAQSCGGLPLALNVIGTAVAGYEEPRDWNSAADAIKENMKFEGVDEMFATLKYSFDRLTPTQQQCFLYCTLFPEYGSISKEHLVDYWLAEGLLLDDREKGNQIIRSLISACLLQTTSSMSSKVKMHHIIRHLGLWLVNREDRSFVVKAGMALDNAPPAIEWKEATRISIMSNNITELSFSPKCENLTTLLIQNNPKLNKLGWGFFKYMRSLKVLDLSHTAITSIPECDKLVALQHLDLSYTHIMRLPERLWLLKELRHLDLSVTVALEDTLNNCSKLHKLRVLNLFRSHYGIRDVDDLNLDSLRDLLFLGITIYSQDVLKKLNETHPLAKSTHRLNLKYCGDMQSIKISDFNHMKHLEELHVESCYDLNTLVADTELTTSCLQALTLSVLPSLENVLVAPMPHNFRYVRKLSISQCPKLLNITWVRRLELLERLVISNCDEMLTIVEEANSTEEQQYGTQTIKMQGYYSEEQDDHAMAESSRNEWNDDYQSVNGESTNGATRQPDFPKLRSIVLTDVKKLRSICTPRDFPCLETLRVEDCPNLRRIPLCSTHNCGKLKQICGSSDWWKKLLWEDKEAVAHMESKYFIPI

SEQ ID NO: 287 - DNA, 2550 bp, Oryza sativa
atggcggcattgccggcctatctcctcctcctcctcctcatcctggtgatcctccgaccagcggctgcgcccggcgccgcttcgcagccgcctacctcggagcctcacctcccgccgccgctgcttgctcagaaggtgcaggtgtggcccaagccgacgtccatctcgtggccgtccgcggtgtacgcgccgctctcgccgtcgttcagcgtccgcgcggtgctgtcccacccgtcgctccgccaggcggtagccttctacacccgcctcatccgcgccgagcgccacgcgccgctggttccccccgccaactacaccctctcccgcgtccccgtccgcaccctcacgctctccgtctccgaccccgacgtcccgctcggccccgccgtcgacgagtcctacacgctctccgtgctcccggactccggatcggccgatatctccgccgccacgccatggggcgccatccgcgggctcgagaccttctcccagctcgcctgggccggcggcggcgccgcctccggtggccagccgatcgtccccagcggcatcgagatctccgaccgcccacacttcacccaccgcggcatcctcctcgacaccgccaggaatttctacccggtccgcgacatcctccacaccctccgcgccatggccttcaacaagctcaatgtcttccactggcacatcaccgacgcccagtccttccccatcgtcctccctaccgtccccaacctcgccaactccggctcctactcccccaccatgcgctacaccgagaacgacgtccggcacatcgtcagcttcgccgcctccttcggcatccgcgtcatccccgagatcgacatgcccgtatactcaaggctaagtgtcgcgcgcttcggatcagggcacacgggttcgtgggcgggagcgtacccggagatcgtcacctgcgcgaacaggttctgggcgccgcacgcggagccggcgctggcggcggagcccggcacggggcagctgaacccgctcaaccccaagacgtaccgcgtggcgcaggacgtgctgcgcgacatggtggccctgttcccggacccgtacctccacggcggcgccgacgaggtgaacacggcgtgctgggaggacgacccggtggtgcgccggttcctcgccgagggcggcacgcacgaccacctcctggagctgttcatcaacgcgacgcgcccgttcgtggcgcaggagctgaaccgcacggtggtctactgggaggacgtcctcctcgggcccaaggtcaccgtcggccccacgattctgcccagggagaccaccatactgcagacgtggaacgacgggccggagaacacgaagcgcgtcgtcgccgcgggctaccgcgccatcgtgtcgtcggcgtcgtactactacctggactgcggccacggcgggtgggtgggcaacgacagccggtacgacaagcaggagaaggagcgcgagggcacgccgctgttcaacgaccccggcggcacgggcgggtcatggtgcgcgccgttcaagacgtggcagcgcgtctacgactacgacatcctgcacgggctgaccgacgacgaggcgcagctggtgctgggcggggaggtggcgctgtggtcggagcagtcggacgagacggtgctggacgccaggctgtggccgagggccgccgccgccgcggagacgctctggtccggcaacaagggctccaacgggaagaagcgctacgcgaacgccaccgaccgcctcaacgactggaggcaccggatggtcgagcgcggcatccgcgccgagcccatccagccgctctgggaacccgccgattgcgaattgttcaagaaagtcgcggacttatgccgtgcagaaaagaaagttttctttttcatcatcagcatcaagacaatcaacttccgggccgactccccattgaactcgtcggcatgcgccgtagatgtgctcattttagcgttgtggtcatggatggcgtccttgatcacagcatatgttatgatggacgtgtccttgtcaagtcacggcggcattcgatttggaatcgatgacaaacttggtcctcttttatcagcagatgataaacttgtggctcctagtttacgatatcctaatccttggtcatatctgacgcttgcttgcagcgacacaactcctggaattgcaagggatgcattcaacacgttcttcagcgagacgagttcaggcaagcacgtcccaagggcgttgttcgtcgacctggagcccacggtgattgatgaggtgaagaccgggccataccgccagctcttccacccagagcagctcatctcctacaaggaagacgctgctaacaactttgctcgtgggcactacacagttggaagagaggtggtagatctttgccttgatcgactaagaaaactggcagataactgcactggtctccaaggttttctggttttcaatgctgttggtggaggaaccggctctggacttggttcattacttttggagcgcctatcagtagattacggtaatcaagaaaagtattcatga

SEQ ID NO: 288 - protein, 849 aa, Oryza sativa
MAALPAYLLLLLLILVILRPAAAPGAASQPPTSEPHLPPPLLAQKVQVWPKPTSISWPSAVYAPLSPSFSVRAVLSHPSLRQAVAFYTRLIRAERHAPLVPPANYTLSRVPVRTLTLSVSDPDVPLGPAVDESYTLSVLPDSGSADISAATPWGAIRGLETFSQLAWAGGGAASGGQPIVPSGIEISDRPHFTHRGILLDTARNFYPVRDILHTLRAMAFNKLNVFHWHITDAQSFPIVLPTVPNLANSGSYSPTMRYTENDVRHIVSFAASFGIRVIPEIDMPVYSRLSVARFGSGHTGSWAGAYPEIVTCANRFWAPHAEPALAAEPGTGQLNPLNPKTYRVAQDVLRDMVALFPDPYLHGGADEVNTACWEDDPVVRRFLAEGGTHDHLLELFINATRPFVAQELNRTVVYWEDVLLGPKVTVGPTILPRETTILQTWNDGPENTKRVVAAGYRAIVSSASYYYLDCGHGGWVGNDSRYDKQEKEREGTPLFNDPGGTGGSWCAPFKTWQRVYDYDILHGLTDDEAQLVLGGEVALWSEQSDETVLDARLWPRAAAAAETLWSGNKGSNGKKRYANATDRLNDWRHRMVERGIRAEPIQPLWEPADCELFKKVADLCRAEKKVFFFIISIKTINFRADSPLNSSACAVDVLILALWSWMASLITAYVMMDVSLSSHGGIRFGIDDKLGPLLSADDKLVAPSLRYPNPWSYLTLACSDTTPGIARDAFNTFFSETSSGKHVPRALFVDLEPTVIDEVKTGPYRQLFHPEQLISYKEDAANNFARGHYTVGREVVDLCLDRLRKLADNCTGLQGFLVFNAVGGGTGSGLGSLLLERLSVDYGNQEKYS

SEQ ID NO: 289 - DNA, 371 bp, Oryza sativa
atggcgtcgaggctggcgcagctacggtccaaggcggcgcaggcgtcggagctcgtgtcgaagcacgggtgcgcctactacaaggaggtgatggagaagaacaagcagcacgtggtgcagccacccaccgtggagaagtgccaggagctctccaagcagctcttctacacccgcctcgccagagtttgccaggccgctatgaggcattttggaaggaatttgatggtgtcaagcaggtatggaagaatagaaaggagctcaaggtagaggaccttggaattgtgacattatttggagttgagctttatgcgtggttctgcgtaggcgagattgttggcagaggattcaccataaccggctataaggtctag

SEQ ID NO: 290 - protein, 42 aa, Oryza sativa
AAWRAPGTSPRWVAAPRAACSSPSPPCSRRTRASTRAPTPAP

SEQ ID NO: 291 - DNA, 1054 bp, Oryza sativa
  misc_feature (937)..(937): s = guanine or cytosine
atggcttctgcctcttctcttggcctattactgatgctcgcggcgctggtctccacggccaccgcgcatttgtcgccgacgttctacgacacgtcgtgcccccgagccatgtccatcatcaagagcaccgtgacggccgccgtgaacaacgagccacgcatgggcgcgtctctgctcaggctgcacttccacgactgcttcgtccaagcagggctgtgacgcctcaattttgctggccggaaacgagaggaatgcagccccaaacttttctgtcagaggctacgacgtcatcgacagcatcaagacgcagatcgaggccgtgtgcaagcagaccgtctcctgcgccgacatcctcaccgtcgccgcccgcgactctgtcgtcgcggcttggaggtccgtcatggagtgttccgctagggagaagggactccaccggagccgctaccgcggcccaggtgattagcagccttgctccttctacagatagcctcgcacagctcatcagcgcgtacgcgagcaagggacttagcgccactgacttggttgctctctcaggtgcacacaatatatataactcctcgatcgatctcctaatcaaccatcaggtgcgcacacgattggtatggcacggtgcaggggcttcaggacgaggctatacaacgagaccaacatcgacgccgcctttgcggcggcgctcaaggccaactgcccggcgacgccgggcagcggcgacggcaacctggcgccgctggacacgacgacgcccaccgcgttcgacaacgcctactaccgcaacctgctgtcgaacaaggggctcctgcactccgaccaggagctgttcagcaacggcagcacggacaacacggtcaggagcttcgcgtccagcgcggcggcgttcggcgccgccttcgcgacggccatggtgaccgccatggasatgggctcgccgctgaccgggacacagggacagatcaggctcatctgctccgccgtcaactcgtgatctgatcgaccggtttgtatatatccagacgctgggcactcgacaacatga

SEQ ID NO: 292 - protein, 335 aa, Oryza sativa
  misc_feature (10)..(10): Xaa = any naturally occuring amino acid
  misc_feature (90)..(90): Xaa = any naturally occuring amino acid
  misc_feature (202)..(202): Xaa = any naturally occuring amino acid
  misc_feature (314)..(314): Xaa = any naturally occuring amino acid
MASASSLGLXLLMLAALVSTATAHLSPTFYDTSCPRAMSIIKSTVTAAVNNEPRMGASLLRLHFHDCFVQQGCDASILLAGNERNAAPNXFSVRGYDVIDSIKTQIEAVCKQTVSCADILTVAARDSVVALGGPSWSVPLGRRDSTGAATAAQVISSLAPSTDSLAQLISAYASKGLSATDLVALSGAHNIYNSSIDLLINXSGAHTIGMARCRGFRTRLYNETNIDAAFAAALKANCPATPGSGDGNLAPLDTTTPTAFDNAYYRNLLSNKGLLHSDQELFSNGSTDNTVRSFASSAAAFGAAFATAMVTAMXMGSPLTGTQGQIRLICSAVNS

SEQ ID NO: 293 - DNA, 1965 bp, Oryza sativa
  misc_feature (1843)..(1843): k = guanine or thymine
  misc_feature (1900)..(1900): y = cytosine or thymine
atggcgcggccgcggcgcgcgtcgacgatgcagctggggctgttcctcgccgcgcttctcctcctcacgccgtcgcctgccggctctgtggcggcggccaagggtggcggtgccaagagcggcggcggcggcaccgtgatcgggatcgacctcggcacgacgtactcgtgcgtcggagtctaccggaacggccatgtcgagatcatcgccaacgaccaggggaaccggatcacgccctcgtgggtcgccttcaccgacggcggcgagcggctcatcggtgaggccgccaagaaccaggcggcggccaacccggagcggaccatctacgacgccaagcggctcatcggccggcagttctccgacgccgaggtgcagcgcgacatgaagctgctgccgttcgccgtcgtcgaccggaacggcaagccgcacgaggtgagcgccatggtgctcacgcggatgaaggagacggccgaggcctacctcggcgagaaggtcacccgcgccgtcgtcaccgtcccggcctacttcaacgacgcgcagcggcaggccaccaaggacgccggcgtcatcgccgggctcaccgtcgaccgcatcatcaacgagcccaccgccgccgccatcgcctacggcatcgacaagaagggcgccgagaagaacgtcctcgtcttcgacctcggcggcggcacgttcgacgtcagcatcctcgccatcgacaacggcgtgttcgaggtccttgccaccaacggcgacacccacctcggcggcgaggacttcgaccaacgcctcatggaccacttcgtcaaggtcatccgccggaagcacggccgcgacatcaccggcgacgcgcgcgcgctgggcaagctccgccgcgagtgcgagcgcgccaagcgcgcgctcagcaaccagcaccaggtgcgcgtcgaggtcgagtccctgttcgacggcgtcgacttgtcggagccgctctcccgggcgcggttcgaggagctcaacagcgacctcttcaagaagacgatggtgccggtgaggaaggccatggcggacgcccggctgagcaagggcgacatcgacgagatcgtcctcgtcggcggcagcaccaggatccccaaggtgcagcagctgctcaaggactacttcggtggcaaggagcccaaccgcggcgtcaaccccgacgaggccgtggcgtacggcgccgccgtgcaggccagcatcatcagcggccacgtcgacgagaacacggagagcatgatcctcctcgacgtcgcgccgctcaccctcggcctggagacggccggcggcgtgatggccaagctgatcccgcgcaacacggtggtgccgacgaagaagacgcaggtgttcaccacgtacaaggacaagcagacgacggtgaccatccaggtgttcgagggcgagcggagcatgacgagggacaaccggctgctcggcaggttcgacctcgccggcatcgcgccggcgccgaggggggcgccgcagatcgaggtgacgttcgaggtggacgcgaacggcatcctcagcgtgctggccgccgacaaggccaccggcaggtcggagaagatcaccatctccggcgacgaccgcaagatcagccaggaggagatcgaccggatggtgcgcgaggcggaggagttcgccgaggaggaccgccggcacagggagcaggtggacgcccggaacagcctggaggcgtacgtctacaacatcaagaacacgctcggcggcaagatggcggacgccatggagggcgaggagaaggacagtggaggaggcggtgagggaggcgtacgagtggctggacggcaacccggacgccggcaaggaggaktacgaggagaagctgagggagctggaggacgtgtgcaaccccgtcatgtcggcggtytaccagaggtccggcggcggcggcggcggcgcaccggaagatggcaacgtcgacgacgaggatga

SEQ ID NO: 294 - protein, 654 aa, Oryza sativa
MARPRRASTMQLGLFLAALLLLTPSPAGSVAAAKGGGAKSGGGGTVIGIDLGTTYSCVGVYRNGHVEIIANDQGNRITPSWVAFTDGGERLIGEAAKNQAAANPERTIYDAKRLIGRQFSDAEVQRDMKLLPFAVVDRNGKPHEVSAMVLTRMKETAEAYLGEKVTRAVVTVPAYFNDAQRQATKDAGVIAGLTVDRIINEPTAAAIAYGIDKKGAEKNVLVFDLGGGTFDVSILAIDNGVFEVLATNGDTHLGGEDFDQRLMDHFVKVIRRKHGRDITGDARALGKLRRECERAKRALSNQHQVRVEVESLFDGVDLSEPLSRARFEELNSDLFKKTMVPVRKAMADARLSKGDIDEIVLVGGSTRIPKVQQLLKDYFGGKEPNRGVNPDEAVAYGAAVQASIISGHVDENTESMILLDVAPLTLGLETAGGVMAKLIPRNTVVPTKKTQVFTTYKDKQTTVTIQVFEGERSMTRDNRLLGRFDLAGIAPAPRGAPQIEVTFEVDANGILSVLAADKATGRSEKITISGDDRKISQEEIDRMVREAEEFAEEDRRHREQVDARNSLEAYVYNIKNTLGGKMADAMEGEEKDSGGGGEGGVRVAGRQPGRRQGGLRGEAEGAGGRVQPRHVGGLPEVRRRRRRRTGRWQRRRRG

SEQ ID NO: 295 - DNA, 1510 bp, Oryza sativa
atggatccgaggcgcagccactgggagagctcgtcggaggacgtgacgaggccgctgctcccgctgcacgacgacgacggcgcggcgggccggcgctcctgcgccgcgctgaggtcgctgctcgccaacaagtacctggcggtcgcgtcgggccccgtggcgtgcgcgctgatctgcggcctcgtcgacctcggcggccaccgcgccgcgcgcaacatgctcggggtgctcgcctgggtgttcctgtggtggattaccgacgccgtgccgctcgccgtcgcgtccatggcgccgctgttcctcttccccgtgttcggcatctcctcctccgacgccgtcgccaaggcctacatggacgacgtcatctccctcgtcctcggcagcttcatcctcgcgctcgccatcgagcactacaacatccaccgccgcctcgctctcaacatcacgtcgctgttctgcggcgacccggtgaagccgccgctgctgctgctgggaatctgcggcaccaccatgttcatcagcatgtggatccacaacacaccgtgcaccgtgatgatgatgccggtggcgacggggatcctgcagcggttcccgttctccaaggcggtggtgctcggcgtcgtgtacgcgtcggcgatcggcgggatggcgacgctgacgggcaccggcgtgaacatcatcctggtggggatgtggtccacctacttcccggagcagccgcccatcaccttcagctcgtggatgtcgttcgggctcccattggcgctcgtcctcttcgtcgcgctctgggccacgctctgcgtcctgtactgctccaagaacaccgggagggcgctctcagcttacctggacaggagccatctcaggagggagctcagcttgcttgggtttgattgtcctatggatgacgaggagcctgacagatgatattcctgggtggggatcactcttccacggcgaagttggggatggaactgtcactatgatggcgacgctgctgttcataatcccgagcggcaagaacgacggcgagaagctcatggactggggcaagtgccggaggctgcagtggaacatcatcctcctcctcggcgccggcttcgccatcgccgacggcttcagggcgagcggcctgaccgacatcctctccgaggggctcggcttcctccgcggcgcgccggcgctggccatcgcgcccgtggcgtgcgtcttcagcggcgccatcaccgagttcacctccgacgacgcgaccgccacgctggtgctcccgctgctcgccgagctgggcaagtccatcggcgtgcacccgctcctcctcatggtccccggcgccgtcggcgcgcagctgtcctacctgctgcccaccggctcgccgggcaacgtcgtcggcttcagcacgggctacatcagcatcaaggacatggtgatcgccggaacgcccctgaaaattgtcggggttgcagctctcaccatcctactgccaacgttaggtaaattaactgacaagtga

SEQ ID NO: 296 - protein, 502 aa, Oryza sativa
MDPRRSHWESSSEDVTRPLLPLHDDDGAAGRRSCAALRSLLANKYLAVASGPVACALICGLVDLGGHRAARNMLGVLAWVFLWWITDAVPLAVASMAPLFLFPVFGISSSDAVAKAYMDDVISLVLGSFILALAIEHYNIHRRLALNITSLFCGDPVKPPLLLLGICGTTMFISMWIHNTPCTVMMMPVATGILQRFPFSKAVVLGVVYASAIGGMATLTGTGVNIILVGMWSTYFPEQPPITFSSWMSFGLPLALVLFVALWATLCVLYCSKNTGRALSAYLDRSHLRRELSLLGLIVLWMTRSLTDDIPGWGSLFHGEVGDGTVTMMATLLFIIPSGKNDGEKLMDWGKCRRLQWNIILLLGAGFAIADGFRASGLTDILSEGLGFLRGAPALAIAPVACVFSGAITEFTSDDATATLVLPLLAELGKSIGVHPLLLMVPGAVGAQLSYLLPTGSPGNVVGFSTGYISIKDMVIAGTPLKIVGVAALTILLPTLGKLTDK

SEQ ID NO: 297 - DNA, 1403 bp, Oryza sativa
atgaagccattggggattcagctatatgagtgtgcccgggggagtcctatctccttcagatcatgccaggctcttgtattgatactgacgttcttatcctatgctagctatcatgccactaggaagactacaagcattgtcaagagtgttcttgatcctaagacagaaaacctagggctgggctccgtttaatgccgacgatggtactgcattgctcggggagatcgacttggcatttctcggagtatatgcaatcggcatgttcttcgctggccatttgggtgatcgggtggatctcaggatacttctgaccatcggaatgataggcactggatttttcactgctgcctttggtgccggcaactggctcaacatacacaacttctactactttctgggtgttcagatgatggctggcctgtttcagtcatccggctggccatctgtggttgcagttgttggtaattggtttggaaagagcaaaagagggctgataatgggaatctggaatgctcatacatctgtgggaaacatatctggttccttaattgcagctgcaatgttgaagtttggatggtcatggtcgtttgtgtttctgttcttgcctgtcggtccggagatgattggaatcgaggaggatatccatgagaaggatgctgagaaggatgacatgagtgcacctctgttggaagaacgatcggcatcaaaagaaaaggcagtcgggttcattcaggcttggagaattcctggtgtagcgccatttgctctctgccttttcttctgcaagcttgtggcttacacattcctgtattggcttccgttttatatcagccacacagatcggtggagtgtacttgtcagacaccgcagccggtgtactgtcaactctgttcgacgtgggtggcgttgtcggcggcatccttgccggccacatctccgaccgcctcgacgcacgggcgctgacggcggcgagcttcacgttctcggcgatcccggcgctcttcttctaccgcatatacggcagcttctcgctgtactcgaacatcgccctcatgttcgtcaccgggatgctcgtcaacgggccgtacgccctcatcaccaccgccgtctccgccgacctcggcacgcacagctccctgaacggcaactccagggcgctcgccaccgtcacggcgatcatcgacgggacggggtcgatcggcgccgcggtcggcccgctgctgacggggtacatctctgccaagagctggagcggcgtgttcacgatgctcatggcgtccgctttcgtcgcggggctgctcctgtcgaggctggtcatggcggagatctccgcgaagatggagtcccggaggcctgacgctgctgctagtgatctgccagtgtcctccatggaacaatcttag

SEQ ID NO: 298 - protein, 466 aa, Oryza sativa
MKPLGIQLYECARGSPISFRSCQALVLILTFLSYASYHATRKTTSIVKSVLDPKTENLGWAPFNADDGTALLGEIDLAFLGVYAIGMFFAGHLGDRVDLRILLTIGMIGTGFFTAAFGAGNWLNIHNFYYFLGVQMMAGLFQSSGWPSVVAVVGNWFGKSKRGLIMGIWNAHTSVGNISGSLIAAAMLKFGWSWSFVFLFLPVGPEMIGIEEDIHEKDAEKDDMSAPLLEERSASKEKAVGFIQAWRIPGVAPFALCLFFCKLVAYTFLYWLPFYISHTDRWSYLSDTAAGVLSTLFDVGGVVGGILAGHISDRLDARALTAASFTFSAIPALFFYRIYGSFSLYSNIALMFVTGMLVNGPYALITTAVSADLGTHSSLNGNSRALATVTAIIDGTGSIGAAVGPLLTGYISAKSWSGVFTMLMASAFVAGLLLSRLVMAEISAKMESRRPDAAASDLPVSSMEQS

SEQ ID NO: 299 - DNA, 393 bp, Oryza sativa
atggctgcgttctggacaggctgcatcaccaccaaggagcttggaactgtgatgcgctcattagggcagaaccccactgaggctgagcttcaggacatgatcaacgaggtggatgctgatggaaatggaacgattgactttcctgagtttctcaacctgatggcacgcaagatgaaggacactgattctgaggaggagctcaaggaagccttccgtgtatttgacaaggaccagaatggcttcatctcggcagctgaactccgtcatgtcatgaccaaccttggtgagaagcttacagacgaggaggtggacgagatgatccgtgaggctgatgtcgatggtgatggtcagatcaattacgaagaattcgtgaaggtgatgatggccaagtga

SEQ ID NO: 300 - protein, 130 aa, Oryza sativa
MAAFWTGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYEEFVKVMMAK

SEQ ID NO: 301 - DNA, 414 bp, Oryza sativa
atggcttcaccggcaataataaccatcctcgccgtgtccctcctgctgctgctgccgccgttagcgcttggctccatcaccggcggcgatcaacgacgcaaggagccttggattactacgatattgaacggtggcggcagtattgcgggcatggagctgcagccaacgacgacgaggaggccatggattgccggtgatggtgagatcagcagcacggcgatctctcggaggacgatcgacacccaacagaagaccctggtgatggtggacgtaaccctccagtctcccctgcacgagacagaccagggacggaagcctgatgaaatgggcaactgtgccctctgtgcccgagagaaattggtcccttggcagaatatccatgatttggtctgtgtaattttgtgcgaaaattga

SEQ ID NO: 302 - protein, 137 aa, Oryza sativa
MASPAIITILAVSLLLLLPPLALGSITGGDQRRKEPWITTILNGGGSIAGMELQPTTTRRPWIAGDGEISSTAISRRTIDTQQKTLVMVDVTLQSPLHETDQGRKPDEMGNCALCAREKLVPWQNIHDLVCVILCEN

SEQ ID NO: 303 - DNA, 1070 bp, Oryza sativa
atgttgagggcggtggcgaggtgctgcgggcactggccgccgggggcggcggcggcggacgggatgctgtggcagacggagctgaggccgcacgcggcgggggagttctcgatggcggcggcgcaggcgaacctggccatggaggaccaggcgcaggtggccacgctcgtcggcgtgtatgacgggcacggcggcgccgacgcctcccgcttcctccgctcccgcctcttcccccatgtccaacgaggaggagttcctgcagcaggtgaggcaggcatggcggcagcggccgaagatggcggccgtgggctcctgctgcctgctcggggctatctccggagacacgctctacgtggccaacctcggcgactcccgcgccgtgctcggccgccgcgtggtcgggggcggggtggccgtcgccgagcggctcaccgacgagcataacgcggcctccgaggaggtccggcgggagctcaccgcgctcaacccggacgatgcgcagatcgtggtgcacgccaggggtgcgtggagggtgaaggggatcattcagcaggtatcgagaaccattggtgatgtttacttgaagaaacaagagtatagcatggatcccgtgtttcgtaacgttggtccccctattcctttgaagcggccagctcttagcgcagaaccatcgattcaagttcgcaagctcaaaccaaatgatctgttcctgatatttgcttcagatggtctctgggagcatctcagtgacgacgctgcggtgcagattgtcttcaagaatccaaggaccgggtatagcaaacagattggtgaaggccgctttaaaggaagccacgaggaagagggaggtcagcttccgtgatctgaagacgatagagaagggagtgaggcgccatttccacgacgacatcagcgtcatcgtcgtctaccttgaccgccaccgcggtcgccgtcacacaagggtcgtcgactcgagcagcaactgcaccaacgcccccgtcgacatctactcctccaactccggccaatccgtggagactcttcaagcccatcggggctccggttggtag

SEQ ID NO: 304 - protein, 51 aa, Oryza sativa
PPAPGPPWPGSPAPPPSRTPPPRAASAPSATASRPPPPPPAASARSTSPPP

SEQ ID NO: 305 - DNA, 318 bp, Oryza sativa
atggcgccatactctcaaggcaagctgtcgggagcgaggtcaatgcttaccacgccattgccagctgctgcaaatgtgcctgcacacctgccgttggctgggaagtggtgctcaccatgggccatcgaagaggacgacggtctcgaggcaggccgccggggtggggcggcggtgcttgccgggtgccactacaggcttgcgcacttgccgtggggcgtcctgaggaggtcgcatcgctcaccgtgggagagtggccggcggaaggagccgtggtcgccatggagacttagagcagggagagaagttgacaaggtgtga

SEQ ID NO: 306 - protein, 105 aa, Oryza sativa
MAPYSQGKLSGARSMLTTPLPAAANVPAHLPLAGKWCSPWAIEEDDGLEAGRRGGAAVLAGCHYRLAHLPWGVLRRSHRSPWESGRRKEPWSPWRLRAGREVDKV

SEQ ID NO: 307 - DNA, 162 bp, Oryza sativa
atggcggccatgtcagcagataacctggtcatctatgtggcgacaacacagcgtggtggcggacaacaagaatgggacaagtggaatgagctagatatgaggacctcacctatctcaacaaccatggccggtgaagacagaagtaccatcaattttacatga

SEQ ID NO: 308 - protein, 53 aa, Oryza sativa
MAAMSADNLVIYVATTQRGGGQQEWDKWNELDMRTSPISTTMAGEDRSTINFT

SEQ ID NO: 309 - DNA, 825 bp, Oryza sativa
atggtgcagtgtctcgacggggtgaggcagctgctggcggtcgtgttcaagtgctgcgacctcgagctgaagcagccgcgggggctcgaggatccccaggtcctcgcgagggagaccgtctagcgtgagcgaggtcgaggcgctgtacgagctcttcaagaagataagcagtgctgtgattgatgacgggctgattaacaaggaggagtttcagttggcgctgttcaagaccagcaagaaggagagcctgttcgccgaccgtgtatttgatttgtttgacacaaaacacaatggaattttaggatttgatgaatttgctcgtgcactctcagtatttcatccaagtgctccacttgatgagaagattgacttcattccagttatatgatctcaagcaacaaggctatattgagagacaagaggttaagcagatggttgttgctacacttgctgagtctggaatgaatctttctgatgaaattatagagagcataatcgataagacatttgaggaggcagacacaaagcatgatggaagaattgataaagaagagtggcgcaatctggttcttcgtcatccctctttgctgaagaacatgactctccagtacctcaacagggacatcaccactacatttccaagctttgtcttccattcccaggtcgatgacacctgaattcttggatttgtttgaactcaaaccatcagaagaatgctcatgccggttcattaagaattttgatattgggttgttggattgggcagagactccagagctctgtaggatgttgcatgttcgatttgagaagttctcaaatctttaa

SEQ ID NO: 310 - protein, 224 aa, Oryza sativa
GAVSRRGEAAAGGRVQVLRPRAESSRGGSRIPRSSRGRPSSVSEVEALYELFKKISSAVIDDGLINKEEFQLALFKTSKKESLFADRVFDLFDTKHNGILGFDEFARALSVFHPSAPLDEKIDSFQLYDLKQQGYIERQEVKQMVVATLAESGMNLSDEIIESIIDKTFEEADTKHDGRIDKEEWRNLVLRHPSLLKNMTLQYLNRDITTTFPSFVFHSQVDDT

SEQ ID NO: 311 - DNA, 1443 bp, Oryza sativa
atggctgtcactagaattggtcttgctggccttgcggtcatggggcagaaccttgccctcaacattgcagagaaagggttccctatctctgtctacaacaggacgacttctaaggttgatgagaccgttcagcgcgccaaggtagaaggaaaccttcctgtgtacgggttccatgaccctgcatcctttgtgaactccattcagaagccacgtgttgtcatcatgcttgtcaaggctggtgcaccagtggaccagaccattgcaactcttgcagcacacttggagcagggtgactgtattattgatggaggaaatgagtggtacgagaacactgagaggagggagaaggcaatggaggagcgtggcctcctctatcttgggatgggtgtttccggaggagaggagggtgcccgcaatggcccgtccttgatgcctggtggctcattcgaggcgtacaagtacattgaagatattcttctcaaggtggctgcccaggttcctgatagtggcccgtgcgtcacatacattggcaaaggtggatctggaaactttgtcaagatggttcacaacggaattgagtatggtgacatgcaactgatttctgaggcatatgatgttctcaagtcagttggtaagctcacaaacagtgagctgcagcaggtgttttctgagtggaacaagggtgagctcctcagtttcctgattgagatcacagccgacatatttagcatcaaggatgaccagggttcaggccacctggtcgacaaggtcctggacaagactgggatgaagggaactgggaagtggactgtgcagcaggccgcagagctttctgtggctgctcctacaattgaggcatccttggattccaggttcctcagtgggttgaaggatgagcgtgttgaggctgccaaggtcttccaaggtgacttctccagcaacttgccagtggacaaggcacagctgattgaagacgtgaggcaggctctttacgcctcgaagatctgcagctacgctcagggcatgaacatcatcaaggccaagagcatggagaaagggtggagcctcaacctcggtgagctagcgaggatctggaagggagggtgcatcatccgtgccatcttcctggaccgcatcaagaaggcctacgacaggaactccgacctcgccaacctgctcgtggaccctgagttcgctcaggagatcatggacaggcaagcggcatggcgcagggtggtctgccttgccatcaacaatggcgtcagcaccccaggcatgtcggcgagtctcgcgtacttcgactcctaccggagggacaggctgcctgccaacctggtgcaggcacagagggactatttcggggctcacacctacgagagggtcgacatgcccggctccttccacaccgagtggttcaagatcgcgcgtgctgctaagatgtga

SEQ ID NO: 312 - protein, 480 aa, Oryza sativa
MAVTRIGLAGLAVMGQNLALNIAEKGFPISVYNRTTSKVDETVQRAKVEGNLPVYGFHDPASFVNSIQKPRVVIMLVKAGAPVDQTIATLAAHLEQGDCIIDGGNEWYENTERREKAMEERGLLYLGMGVSGGEEGARNGPSLMPGGSFEAYKYIEDILLKVAAQVPDSGPCVTYIGKGGSGNFVKMVHNGIEYGDMQLISEAYDVLKSVGKLTNSELQQVFSEWNKGELLSFLIEITADIFSIKDDQGSGHLVDKVLDKTGMKGTGKWTVQQAAELSVAAPTIEASLDSRFLSGLKDERVEAAKVFQGDFSSNLPVDKAQLIEDVRQALYASKICSYAQGMNIIKAKSMEKGWSLNLGELARIWKGGCIIRAIFLDRIKKAYDRNSDLANLLVDPEFAQEIMDRQAAWRRVVCLAINNGVSTPGMSASLAYFDSYRRDRLPANLVQAQRDYFGAHTYERVDMPGSFHTEWFKIARAAKM

SEQ ID NO: 313 - DNA, 1656 bp, Oryza sativa
atgtgtgacaaggatccgggcataaagctcttcgggcgggtgatcccgctggctccagaggctgaggctgctgcggcggcggacggctccgaccagccggaggcggcggcggcggcggcggcggaggttgagccggcggcgcaggatgaggatcatcacaaggaaacagaagaaagaaaatatgatgaaatgaaggttgatgtgccacaagaggaggaagataacgaaatgaaggtcgatgcaccacaagagaaaaaggataatgaagtgacggctgatgtgccagaagagaagggaaatgatgaaatgagggttgatgcatcagagtcaatagaaagcatagagccagtcagcagatctaccttggacaataaaaaagaagatcagggtcagatgaacaacgttgaagagaaagcagcatcagactcaaaagatgaaaatgaaaagacagcaaatgatgaatcaggccaggacaaagtacttaagaagccagataagattctcccttgccctcggtgcaacagtatggacacaaagttttgttattacaacaactacaatgttaatcaacccaggcacttctgtaagaactgccaaaggtattggactgccgggggaaccatgagaaatgtacctgttggtgctgggaggcgcaaaagcaagagctcatcgttgcactaccgtcacttactgatggcccctgattgcatgatggggtctagagtggaaatatccaagtcaatgaaccctgaagctttcgcatctgcgcattcgacccctatacaaccaattggcagaaacgaaacagttctcaaatttgggcctgaggtgccactctgtgaatcgatggcatcagtgctgaacattcaggagcagaatggaaccaatgctgcagcagtaccaacgggtgaaaatcaggaagataactcttgcatctcttcaatcacatcacacaacgtgttacctgaaaatgcagcccaagttgacaagaacagcacgccggtgtattgcaacggagtcggcccagtgccgcagtactaccttggagctccttacatgtacccatggaacataggatggaacaacgttcctatgatggtgccaggtacaagcatgccagagtctgcttcccaatctgagagctgcagcaccagttcagctccatggatgaacatgaactcccccatgatgccggttgcctcgaggctttctgcaccaccatttccataccctctagtgccacctgcactatggggttgcttatccagctggccggccacggcatggaacataccgtggatcagaacgaatggcggctgcatgtctccatcgtcgtcgagcaacagcagctgttcaggcaatggctcccctctggggaagcattccagggactcctctctcccactgaaggaggacaaggaggagaaatcactgtgggttcccaagacgctccgcatcgacgatcccgacgaggcggcgaagagctccatctgggccaccctggggatcaagcctggagaccctggcatcttcaagccgttccagtccaaaggtgagagcaaaggccaagcagcatcagagactcgtcctgctcgtgctcttaaggcaaacccagctgcattgtcgcggtcgcagtcgttccaggagacttcttga

SEQ ID NO: 314 - protein, 551 aa, Oryza sativa
MCDKDPGIKLFGRVIPLAPEAEAAAAADGSDQPEAAAAAAAEVEPAAQDEDHHKETEERKYDEMKVDVPQEEEDNEMKVDAPQEKKDNEVTADVPEEKGNDEMRVDASESIESIEPVSRSTLDNKKEDQGQMNNVEEKAASDSKDENEKTANDESGQDKVLKKPDKILPCPRCNSMDTKFCYYNNYNVNQPRHFCKNCQRYWTAGGTMRNVPVGAGRRKSKSSSLHYRHLLMAPDCMMGSRVEISKSMNPEAFASAHSTPIQPIGRNETVLKFGPEVPLCESMASVLNIQEQNGTNAAAVPTGENQEDNSCISSITSHNVLPENAAQVDKNSTPVYCNGVGPVPQYYLGAPYMYPWNIGWNNVPMMVPGTSMPESASQSESCSTSSAPWMNMNSPMMPVASRLSAPPFPYPLVPPALWGCLSSWPATAWNIPWIRTNGGCMSPSSSSNSSCSGNGSPLGKHSRDSSLPLKEDKEEKSLWVPKTLRIDDPDEAAKSSIWATLGIKPGDPGIFKPFQSKGESKGQAASETRPARALKANPAALSRSQSFQETS

SEQ ID NO: 315 - DNA, 345 bp, Oryza sativa
atggcggcggccgatcaggtcggaacagagctcgatctttccacggcgaccattgagcgactccggtgtccaaattatgaggctgcgacgaaatataagtgggcattccaggccagatcagcagaaacacctagcttcctaggcttgtcaaagcttattacagttgtcaggtactcccataacccagtactgatgctgcactgctttggcatccttggcaagacttttgatttatctctggctgtcaaattaggtcagaaccaccctgtcctagtcagaagagaatcagccaggggccataggcatcatcaagtatatgatcatgaccatgccgcttgtcactga

SEQ ID NO: 316 - protein, 114 aa, Oryza sativa
MAAADQVGTELDLSTATIERLRCPNYEAATKYKWAFQARSAETPSFLGLSKLITVVRYSHNPVLMLHCFGILGKTFDLSLAVKLGQNHPVLVRRESARGHRHHQVYDHDHAACH

SEQ ID NO: 317 - DNA, 4173 bp, Oryza sativa
  misc_feature (2859)..(2859): m = adenine or cytosine
atgacggacgatgagctcgtcaagaagctacttgactcagtgcctgaaaagtttttgcacataattgcagcgatagagcaattctgcgatttggacaccatgccatttgaggaggctattggccgcctcaaagctttcgaggagaggatacggaagcacagtgacaatgatggggagcagcttcttctcaccacacgcaacactgatgatggtgctggtcgagcccgcggcaagaggtttgataaatccaagtttggctccagctcattggcgagatgccgacgtgccgtgcgatgcggtggtgcgagaatggagcaaacaacgttcatgaagaccaagctcaactgcatgtggagtgctgcgagaagtagccgaattgcaagcaagacaagaagatgtacctcggcattatggtacaacgacatcccccggcgcacggtggtgtgggtcgccgaccggggaactccggtcacaaacagcagttcgtctgcgccgacgctgtcgctgaccaactcctccaacctcgtcttgtccgacgcagatggcggcgttcgctggacgaccaacatcaccgacgatgcagcgggcggcggctccacggcggtgctcctgaacaccggcaacctcgtcgtccggtcaccgaacggcaccaccctgtggcagagcttcgagcacccgagtgactcgttcctgcccggcatgaagatgcgggtcatgtacaggacgcgcgccggcgagcgcctggtgtcgtggaagggccccgacgacccgtcgccggggagcttctcgttcggcggcgacccgggcacgttcctccaggtgttcctctggaacgggacgcgcccggtttcgagggacgggccatggacgggcgacatggtgtcgagccagtaccaggcgaacaccagcgacatcatctactccgccatcgtcgacaacgacgacgagagatacatgacgttcaccgtctccgacggctcgccgcacaccaggtacgtgctgacctacgccggcaagtaccagctccagagctgggacaacagctcgtcggcgtgggcggtgctcggcgagtggccgacctgggactgcaaccgctacggctactgcggcccgttcggctactgcgacaacacggcgagggcgcccgccgtcccgacgtgcaagtgcctcgccggcttcgagccggcgagcgcggcggagtggagcagcggcaggttctcgcgtggttgccggcgcacggaggcggtggagtgcggcgaccgtttcttggccgtgccggggatgaagtcgccggacaagttcgtgctcgtcccgaacaggacgctcgacgcgtgcgccgccgagtgcagcagcaactgctcgtgcgtggcgtacgcgtacgccaacctgagcagcagcgggtccaagggcgacatgacgaggtgcttggtgtggtcaggggagctggttgatacagagaaggaaggtgaagggctaagcagcgacacgatctacctcaggcttgctggtcttgaccttgacgcgggtggaaggaaaaagagtaatgcaatcaagatagtactgccagtgttaggctgtattctgattgtcctatgcattttctttgcatggttaaaaatcaaaggcaggaaaacaaaccaggaaaagcacagaaagctaatttttgatggcgaaggaagcactgtccaagattttgaactcccatttgtaagatttgaggacattgctctagcaaccaacaatttctcagaaacaaataagattgggcaaggaggtttcggaaaagtttacatggcaatgctaggtggtcaagaagttgctattaagcggttaagtaaggattctcgacaagggacaaaggaattcaggaatgaagttattcttatcgcgaaattgcaacacagaaatttggttcgccttcttggctgttgtgttgagggagatgaaaaactgctaatatatgagtacttgcctaacaaaggcttagatgctaccctttttgatggttcaagaaaaatgaaactagactggacaacacggtttaatataatcaaaggggtggcaaggggacttctttatctgcaccaagactctagattgaccataattcacagagatctcaaagctggcaatgttttgctagatgctgaaatgaaacccaagatagcagattttggcatggcaaggatctttggtgataatcaacaggatgcaaatacccagcgtgttgttggaacatatggctacatggctcctgagtatgcaatggaaggtatcttctctactaaatcagatgtctacagctttggtgtgttattgttggaaattgtgactggtataaggagaagctccactagcaatatcatgaactttccaaacctcatagtttattcatggaacatgtggaaggaagggaaaagcaaggatttggtagactcatcaattatggatagttgcttactacatgaagttttgctctgcatccatgtagcattgttatgtgttcaagaaagcccagatgacaggccacttatgtcatctattgtgttcaccctggagaatgggagtagtgttgcactgctcccagccccaagttgccctgggcactttacacaaaggagttctgagatagagccaatgaaagataatactcagaactcaatgaatacttttacgctaacaaacatagagggaagaattctgctgaagaaagttttgatggatcggtcagctgcggctttagcctgcatcaccagtgttcttctcctcctcctgccgccgccatgtgcatccgacgatcggcttgtcaccggcaagccgctctcccctggcgccaccatcgtctccgatggcggcgcmttcgccttgggcttcttctccccctccaactcaactccggagaagatgtacctcggcatatggtacaatgacatccccgggcgcacggtggtgtgggtcgccgaccgaggaactccggtcacaaacagtagttcgtctttgccgacgctgtcgctgaccaactcctccaaccttctcttgtccgacgccgacggccgcgttcgctggacgagcaacatcaccgacgatgcagcgggctccggctccaccgcagtgctcaagaacgacggcaacctcgtcgtccggtcaccgaacggcaccaccctgtggcagagcttcgagcacccgaccgactcgttcctccctgggatgaagcttggggtgacgttcaagacgcgcacatgcgagcgcttggtgtcgtggaagggccccgacgacccgtcgccggggagcttctcgttcggcggcgacccggacacgttcctgcaggtgttcatctggaacgggacgcgcccggtttcgagggacgggccatggacgggctacatggtgtcgagccagtatcaggcgaactccagcgacatcttctacttctccatcgtcaacaacgaggaaaagagatacataacgttcagcgtctccgagggctcgccgtacaccaggtatgtgattacctacgccggcaagtaccagttccagcgctggaacatcagctcgtcggcgtgggatgtcgcggagtggcctagatgggactgcaactattacaactactgcggcccgaacggctactgcgacaacacagcgagggcgcctgctgtcccgacgtgcaagtgcctcttcggcttcgagccagcgaacgcggcggagtggaacagcggccggttttcgcagggttgccggcgaaaggaggcggtgcagtgcggcgaccgtttcttggccgtgccggggatgatttcgccggacaagttcgtgctcttcccgaacaggacgctcgacgcgtgcgccgccgagtgcagcagcaactgctcctgcgtggcgtacgcctacgccaacctgagtagcagcatatctaagggcgacaagacgaggtgcttggtgtggtcaggggagctgattgacgcggagatggtaggcgaaaggcttggcagcgacacgatctacctcaggctcgccggtcttgacgcgggtaagcaccaatttaaattgagcaattttactgttcgtaaggagaagtacggattacaatttgaggtattttactgtttgaggtttatacttttagtccttgagttgagaaagtactaccagatacagcgaggtgctaatgaaatataa

SEQ ID NO: 318 - protein, 1390 aa, Oryza sativa
MTDDELVKKLLDSVPEKFLHIIAAIEQFCDLDTMPFEEAIGRLKAFEERIRKHSDNDGEQLLLTTRNTDDGAGRARGKRFDKSKFGSSSLARCRRAVRCGGARMEQTTFMKTKLNCMWSAARSSRIASKTRRCTSALWYNDIPRRTVVWVADRGTPVTNSSSSAPTLSLTNSSNLVLSDADGGVRWTTNITDDAAGGGSTAVLLNTGNLVVRSPNGTTLWQSFEHPSDSFLPGMKMRVMYRTRAGERLVSWKGPDDPSPGSFSFGGDPGTFLQVFLWNGTRPVSRDGPWTGDMVSSQYQANTSDIIYSAIVDNDDERYMTFTVSDGSPHTRYVLTYAGKYQLQSWDNSSSAWAVLGEWPTWDCNRYGYCGPFGYCDNTARAPAVPTCKCLAGFEPASAAEWSSGRFSRGCRRTEAVECGDRFLAVPGMKSPDKFVLVPNRTLDACAAECSSNCSCVAYAYANLSSSGSKGDMTRCLVWSGELVDTEKEGEGLSSDTIYLRLAGLDLDAGGRKKSNAIKIVLPVLGCILIVLCIFFAWLKIKGRKTNQEKHRKLIFDGEGSTVQDFELPFVRFEDIALATNNFSETNKIGQGGFGKVYMAMLGGQEVAIKRLSKDSRQGTKEFRNEVILIAKLQHRNLVRLLGCCVEGDEKLLIYEYLPNKGLDATLFDGSRKMKLDWTTRFNIIKGVARGLLYLHQDSRLTIIHRDLKAGNVLLDAEMKPKIADFGMARIFGDNQQDANTQRVVGTYGYMAPEYAMEGIFSTKSDVYSFGVLLLEIVTGIRRSSTSNIMNFPNLIVYSWNMWKEGKSKDLVDSSIMDSCLLHEVLLCIHVALLCVQESPDDRPLMSSIVFTLENGSSVALLPAPSCPGHFTQRSSEIEPMKDNTQNSMNTFTLTNIEGRILLKKVLMDRSAAALACITSVLLLLLPPPCASDDRLVTGKPLSPGATIVSDGGAFALGFFSPSNSTPEKMYLGIWYNDIPGRTVVWVADRGTPVTNSSSSLPTLSLTNSSNLLLSDADGRVRWTSNITDDAAGSGSTAVLKNDGNLVVRSPNGTTLWQSFEHPTDSFLPGMKLGVTFKTRTCERLVSWKGPDDPSPGSFSFGGDPDTFLQVFIWNGTRPVSRDGPWTGYMVSSQYQANSSDIFYFSIVNNEEKRYITFSVSEGSPYTRYVITYAGKYQFQRWNISSSAWDVAEWPRWDCNYYNYCGPNGYCDNTARAPAVPTCKCLFGFEPANAAEWNSGRFSQGCRRKEAVQCGDRFLAVPGMISPDKFVLFPNRTLDACAAECSSNCSCVAYAYANLSSSISKGDKTRCLVWSGELIDAEMVGERLGSDTIYLRLAGLDAGKHQFKLSNFTVRKEKYGLQFEVFYCLRFILLVLELRKYYQIQRGANEI

SEQ ID NO: 319 - DNA, 612 bp, Oryza sativa
atgggccgagacaagctaataagctccaaggctccaagcaaagtaattaagatgaccatgaaagtgaagagcaccatgatggctgcttccatgctgctcttcctcctcgtcctcgccggcatcgtcaccgccaccaccaccaccaccgacagcaacattcgcctccccagcaacggcgccgccggcgaaaccgatggaaacaaacaggcgaaatccagaccgtgggagtgctgcgacaacatcgagatgtccgtgctcaagatctacccgccgcggtggcgttgcaacgacgaggtgaagcagtgcgccgccgcctgcgagaactgcctgcagctggtgcccggggccggcggcgaagatgtcgtcttcgtctgcgacgactggtacccgaccaccaaccctggccccgtctgcacgccgcggccgtggggcgattgctgcgacaaggccttctgcaccaggtctctcccaccgatctgccactgcgccgacgaggtggcgtcgtgcgccgccgcctgcaaggagtgcgacatggtgaattcgtcgtcggagccgcctcgctatatctgccgcgaccacttcaccggcgagcccgggcccatgtgcgcatga

SEQ ID NO: 320 - protein, 203 aa, Oryza sativa
MGRDKLISSKAPSKVIKMTMKVKSTMMAASMLLFLLVLAGIVTATTTTTDSNIRLPSNGAAGETDGNKQAKSRPWECCDNIEMSVLKIYPPRWRCNDEVKQCAAACENCLQLVPGAGGEDVVFVCDDWYPTTNPGPVCTPRPWGDCCDKAFCTRSLPPICHCADEVASCAAACKECDMVNSSSEPPRYICRDHFTGEPGPMCA

SEQ ID NO: 321 - DNA, 1110 bp, Oryza sativa
  misc_feature (180)..(180): k = guanine or thymine
  misc_feature (183)..(183): r = adenine or guanine
  misc_feature (186)..(186): k = guanine or thymine
  misc_feature (192)..(192): k = guanine or thymine
  misc_feature (217)..(217): k = guanine or thymine
  misc_feature (248)..(248): s = guanine or cytosine
atgcgaccgggcgggccgccgagcttgcgggcggggctgcagcagcagcagcagcagcagccggggacgccggggaggtcgcggcgccggccggatctcacgctgccgctgccgcagcgggacctcacgtcgctcgcggtgccgctgccgctgccgctgccgccgtcgtcggcgccgtcktcracktcgtcktccgggtcgtcctcgctcggcggcktgccaacccggccgaattcggtcggctccgsgccgccggccccgccgccgctgtcggagctggagcgcgtccgccgcatcgggagcggcgcgggcgggacggtgtggatggtgcggcaccgccccacggggcggccgtacgcgctcaaggtgctctacgggaaccacgacgacgccgtgcggcggcagatcacgcgcgagatcgcgatcctccgcaccgccgagcacccggccgtcgtgcggtgccacggcatgtacgagcaggccggcgagctccagatcctgctcgagtacatggacgggggatccctcgagggccgccgcatcgcctccgaggccttcctcgccgacgtcgcgcgccaggtgctctccgggatcgcctacctccaccgccgccacatcgtccaccgcgacatcaagccatccaacctcctcatcgactccggccgccgcgtcaagatcgccgacttcggcgtcggccgcatcctcaaccagaccatggacccctgcaactcctccgtcgggaccatcgcctacatgagccccgagcgcatcaacaccgacctcaacgacggcgcctacgacggctacgccggcgacatctggagcttcggcctgagcattctcgagttctacatgggcaggttccccctcggggagaatctcggcaagcagggagactgggccgccctcatgtgcgcgatttgctactccgactcgccggcgccgccgcccaacgcctcgccggagttcaagagcttcatcagctgctgcctccagaagaacccggcgcggcggccatcggcggcgcagcttctccaacatcggttcgtcgccgggccacagcagcagcagcagccgcagccgcagcccctcgcaccgcctccgtcatga

SEQ ID NO: 322 - protein, 369 aa, Oryza sativa
MRPGGPPSLRAGLQQQQQQQPGTPGRSRRRPDLTLPLPQRDLTSLAVPLPLPLPPSSAPSSTSSSGSSSLGGLPTRPNSVGSGPPAPPPLSELERVRRIGSGAGGTVWMVRHRPTGRPYALKVLYGNHDDAVRRQITREIAILRTAEHPAVVRCHGMYEQAGELQILLEYMDGGSLEGRRIASEAFLADVARQVLSGIAYLHRRHIVHRDIKPSNLLIDSGRRVKIADFGVGRILNQTMDPCNSSVGTIAYMSPERINTDLNDGAYDGYAGDIWSFGLSILEFYMGRFPLGENLGKQGDWAALMCAICYSDSPAPPPNASPEFKSFISCCLQKNPARRPSAAQLLQHRFVAGPQQQQQPQPQPLAPPPS

SEQ ID NO: 323 - DNA, 693 bp, Oryza sativa
atggcgtccgcggcggcggagaaggggaaggctccggccgacacagagcagacggcggcggcgaccgccgcgcggctcgcggcggagtggaccacgtgggcgatgaagaacgcgaaggtagtggcccactacggattcatcccgctcgtcatcctcatcggctatgaactccgagcccaagccccgcctcggcccagctcctctccccaatctaggggtcctagctcaattctcgccagctgctattcggctgttcctcaccacgataaaattgaggttgcaaactttgctattgtggatgcattcttgttctattcatcgaggctcgagcggaagcggttggactggatggacacagagatggaggacttcctgactgaggctaggtttcactgtcgttggcacctgcttgctgctgggagcacaggcgccagtgggtttccgaattccaaaccgccggagccggggttatcacgccccggtggtaagcacggttaccacgtggttaccgtggtttttttattaccgtaccaccgcggtaaggcaagttaccgcgcggataccgacggtggaaagtttaccgcgcaggcacagtgtcactctgcacggtatgatcatggtaccttgcctcgcttctcgtcgagagaagcatccatggacaagccagacatcagtgcgggggatatttcttga

SEQ ID NO: 324 - protein, 230 aa, Oryza sativa
MASAAAEKGKAPADTEQTAAATAARLAAEWTTWAMKNAKVVAHYGFIPLVILIGYELRAQAPPRPSSSPQSRGPSSILASCYSAVPHHDKIEVANFAIVDAFLFYSSRLERKRLDWMDTEMEDFLTEARFHCRWHLLAAGSTGASGFPNSKPPEPGLSRPGGKHGYHVVTVVFLLPYHRGKASYRADTDGGKFTAQAQCHSARYDHGTLPRFSSREASMDKPDISAGDIS

SEQ ID NO: 325 - DNA, 597 bp, Oryza sativa
atggcttcgtcgctggccctggtagctctgctcctcgtgagctgcgccgtggtggcggcggcggcgaccaagtacaccgtcggcgacacgtccggctgggattacaccacctgggccagcgacaagaaattcaaaatgggcgataccctcggtgagcgccatgtgttcaactacgccggtggggcgcactcggtggatgaggtgagcgcagcggactacgctgcgtgcaccgctagcaacgcgctccagagcgacagcagcggcacgaccaccgtcaccctcaagaccgccggcaagcactacttcatctgcggcatcgccggccactgcagcaacggcatgaagctcgtcgtggacgttgccgcggcctctccagccccagccccaaaagccccgtccaccacaccgacgactccatctacgacaccagcgacaccggcgtcccctggcacaagctccggtctgacgcccacaaccccagcaacggtgctcgcgccgcccgccaagcagtccgccggtgcagctgggctcagggccaggtcatgggctatgctgggcctggcaggacttgccgccgtgcaactgggcctcttctag

SEQ ID NO: 326 - protein, 198 aa, Oryza sativa
MASSLALVALLLVSCAVVAAAATKYTVGDTSGWDYTTWASDKKFKMGDTLGERHVFNYAGGAHSVDEVSAADYAACTASNALQSDSSGTTTVTLKTAGKHYFICGIAGHCSNGMKLVVDVAAASPAPAPKAPSTTPTTPSTTPATPASPGTSSGLTPTTPATVLAPPAKQSAGAAGLRARSWAMLGLAGLAAVQLGLF

SEQ ID NO: 327 - DNA, 780 bp, Oryza sativa
atgtggtgccagtcgtgcaaggaggagtacgaggaggaggacgccgggacgtgcaaggagtgctacgaggaggcgagcgagacggaggaggagctcaagcgcgagatcgacgacctccgctcccgcctccacttcctccgcctcccttccccttccctcgacgcctcctccctctcccactccgacctcctcctccacgccatccccgccgatgcgcccgcccgccccgacacccccgccgtccccgcccaccgcgtcatcctcgccagcagatctcctgttttcagagctatgcttgagaacgagatggaagagagccggagtggcatcatcaaaatatacgatgtgtcctacgacgtccttcgtgctttcgtccattacatgtacacagcagaagctctccttgacgagcagatggcatctgatctcctggtgttggctgagaagtacgaagtgaagaacctgaaggcctactgtgagaaattcttaacatccaaagtgagcaacgacaatgccatcacgcattatgcgtttgcgcatcgccacagcgcgaagcagctgctcgagacatccctggcagcgatcatggacaacatgtcaacgctggcagatcgggaggaatacaaggagcttgttgagaaggacccaaggcttgttgtggagatatatgaagcctatctgaacagacaagtgaacactgctgctgggaaggagacagattccagtagtaggaagggcgtgctcaacaagatgtgcgacatcatccagaccaatgtttag

SEQ ID NO: 328 - protein, 259 aa, Oryza sativa
MWCQSCKEEYEEEDAGTCKECYEEASETEEELKREIDDLRSRLHFLRLPSPSLDASSLSHSDLLLHAIPADAPARPDTPAVPAHRVILASRSPVFRAMLENEMEESRSGIIKIYDVSYDVLRAFVHYMYTAEALLDEQMASDLLVLAEKYEVKNLKAYCEKFLTSKVSNDNAITHYAFAHRHSAKQLLETSLAAIMDNMSTLADREEYKELVEKDPRLVVEIYEAYLNRQVNTAAGKETDSSSRKGVLNKMCDIIQTNV

SEQ ID NO: 329 - DNA, 1006 bp, Oryza sativa
  misc_feature (811)..(811): y = cytosine or thymine
  misc_feature (817)..(817): y = cytosine or thymine
  misc_feature (824)..(824): y = cytosine or thymine
  misc_feature (847)..(847): y = cytosine or thymine
atggcgcttgacggcgccgcggcggccgtgtccacgttcggcgccgtgacggtcgaccagagcggcgccggcaacttcacgaccgtctcggacgccgtggcggcggcgccgacgaacctcgacggcaccaagggctacttcgtgatacacgtcaccgccggcgtgtacgcggagaatgtggtggtgcccaagaacaagaagtacgtgatgatggtcggcgacggcatcgggcagacggtgatcaccggcaaccggagcgtcgtcgacggctggacgaccttcaactccgccacgttcgacacatgcagctgtgctcgggcaaggattcgtggcggtgaacatgacgttcaggaacacggccgggccggcgaagcaccaggcggtggcgctccggtgcggcgccgacctgtcgacgttctaccagtgcagcttcgaggcgtaccaggacacgctgtacacgcactcgctccggcagttctaccgcgcctgcgacgtctacggcaccgtcgactacgtgttcggcaacgccgccgtggttttccaggactgcaccctctacaaccgcctccccatgcaggggcagagcaacaccgtcacggcgcaggggcgcaccgaccccaaccagaacaccggcaccaccatccagggctgcgccatcgtcgcggcgcccgacctcgccgccaacacggcgttcgccaccaccaactacctcggccgcccgtggaagctctactcgcgcacggtgatcatgcagtccgtcgtcggcgggctcatcgaccccgccgggtggatgccgtgggacggcgactaygcgctyagcacgytctactacgccgagtacaacaaytccggcgccggggcggacaccagcaggagggtgacctggccggggtaccacgtgctcaacagcaccgccgacgccggcaacttcaccgtcggcaacatggtgctcggcgacttctggctgccgcagaccggcgtgccgttcaccagcggcctcaactga

SEQ ID NO: 330 - protein, 334 aa, Oryza sativa
  misc_feature (275)..(275): Xaa = any naturally occuring amino acid
MALDGAAAAVSTFGAVTVDQSGAGNFTTVSDAVAAAPTNLDGTKGYFVIHVTAGVYAENVVVPKNKKYVMMVGDGIGQTVITGNRSVVDGWTTFNSATFTHAAVLGQGFVAVNMTFRNTAGPAKHQAVALRCGADLSTFYQCSFEAYQDTLYTHSLRQFYRACDVYGTVDYVFGNAAVVFQDCTLYNRLPMQGQSNTVTAQGRTDPNQNTGTTIQGCAIVAAPDLAANTAFATTNYLGRPWKLYSRTVIMQSVVGGLIDPAGWMPWDGDYALSTXYYAEYNNSGAGADTSRRVTWPGYHVLNSTADAGNFTVGNMVLGDFWLPQTGVPFTSGLN

SEQ ID NO: 331 - DNA, 1815 bp, Oryza sativa
atggacgtgatcctgcggtccggcacgccgtggaataacgcatggcgatcaaagaccaaggacgattggaagggagacgaacagagctcttggggcagcaacttcgcctgcaggcttcgtcagtggcttctccacggcttccaactctgcgcagaggttcgctctttggtcaagttggctggcaaggtggctgtcataaccggtggagctagcggcatcggcaaagcgacagccaaggagttcatcgagaatggcgccaaggtcatcatggccgatgtccaggatgacctcggccactccaccgcagcggagctcggcccggacgcctcgtacacgcgctgcgacgtcaccgacgaggcacaggtcgcggcggccgtcgacctcgccgtgaagcggcacggccacctcgacatcctctacaacaacgccggtgtcatgggcgccatgccgcaggacgacatggcgtccgtcgacctcgccaacttcgaccgcatgatggcgatcaacgcccgggcggcgcttgtcggcatcaagcacgccgcgcgcgtcatgtcgccccgccgcagcggcgtcatcctctgcacggccagcgacacgggcgtcatgcccatgcccaacatcgccttgtacgccgtctccaaggcaaccaccatcgccatcgtgcgcgccgcggcggagccgctgtcgcgccacggcctgcgggtgaacgccatctcgccgcacggcaccaggacgccgatggcgatgcacgtgttatctcagatgtaccccggcgtaagcaaagatgatttggagaagatggcggacgccgccatggacgccggagaggtgatggaacctaagtacgtcgctagggcggcgctgtatttggcttcggacgaggctaacttggaggataagacacgtgcaaattgccatggaaaattggcaatgccacaagagaagagaaggtccaccttatcaacaacaattaagagaaaccatgtggaagaagctgacactgtactgattccggcacgcaataatagaagacaagagacaaggggtagtttggctggcaaggtggctatcattaccggtggagccagtggcatcggaaaggttacagcaaaggagttcatcaagaatggtgccaaggtcatcatcgccgatgtccaggacgagctcggccactctgcggcggccaagctcggcccggacgcctcgtacacgcactgcgatgtcaccgacgaggcgcaggtcgaggcggccgtggacctcgctgtgaggctccacggccacctcgacatcctctacaacaacgctggcatcatcggcgccatgccgcaggacgacatggcgtccgtcgacctcgccaacttcgaccgcatgatggcgatcaacgcccgggcggcgctcgtcggcatcaagcacgccgcgcgcgtcatggcgccgcgccgcagcggcgtcatcctctgcacggcgagcgacgcgggcgtcatgcccatcccgaacatcgccatgtactccgtctccaaggcgaccaccatcgccatcgtgcgcgccgcggcggagccgctgtcgcgccacggcctgcgggtgaacgccatctcgccgacgggcaccaggacgccgatgatgatgcatatcatctcccagatgacccccggcgtgggcgaggacgacctggagcggatggcggacgccgccatcagcgccggcgtggccatcgagccggagtacgtcgcgagggcggcggtgtacctcgcctccgacgaggccaagtacgtcaacgggcataacctcgtcgtcgaacggcggcttcacaacgcataa

SEQ ID NO: 332 - protein, 604 aa, Oryza sativa
MDVILRSGTPWNNAWRSKTKDDWKGDEQSSWGSNFACRLRQWLLHGFQLCAEVRSLVKLAGKVAVITGGASGIGKATAKEFIENGAKVIMADVQDDLGHSTAAELGPDASYTRCDVTDEAQVAAAVDLAVKRHGHLDILYNNAGVMGAMPQDDMASVDLANFDRMMAINARAALVGIKHAARVMSPRRSGVILCTASDTGVMPMPNIALYAVSKATTIAIVRAAAEPLSRHGLRVNAISPHGTRTPMAMHVLSQMYPGVSKDDLEKMADAAMDAGEVMEPKYVARAALYLASDEANLEDKTRANCHGKLAMPQEKRRSTLSTTIKRNHVEEADTVLIPARNNRRQETRGSLAGKVAIITGGASGIGKVTAKEFIKNGAKVIIADVQDELGHSAAAKLGPDASYTHCDVTDEAQVEAAVDLAVRLHGHLDILYNNAGIIGAMPQDDMASVDLANFDRMMAINARAALVGIKHAARVMAPRRSGVILCTASDAGVMPIPNIAMYSVSKATTIAIVRAAAEPLSRHGLRVNAISPTGTRTPMMMHIISQMTPGVGEDDLERMADAAISAGVAIEPEYVARAAVYLASDEAKYVNGHNLVVERRLHNA

SEQ ID NO: 333 - DNA, 811 bp, Oryza sativa
  misc_feature (50)..(50): y = cytosine or thymine
atggccaccgtggggcagcctgatgcacatgagcaaggatcaccgttcaytacgtgaatccgccgccgatcgccggcgccggagaagcacacgtcgatggcctcgacgacgaggttcttgattatgtgattggtgatgttcttcaggatcagaggagggtctgtatcaatcgatattgtatggcaaatacggggatgacatgagaggggcaagaaacactgctcttgcccaatctgatggtttacattactactatcacggagagaacagcagtggtgaagcaacaacctcgagaaattcagaaatcgaccaacagattgagtatgacttggtgttcgctaggcagctgcaggcaatggataatctgacaaattgagacacctgcagatgaagatgatggattcagatataagctgcgtaccctctccatctgactctgaaaccgatgaaccggcagaaggcaacaacgaagagaggctgccacacaggatgataacgatgatccagacaacatgacatacgagagcaaaggcaggcacttgtggaatctgtaggaaatgagaacagaggtttatctgatctgcttatctcctacttggagacatggaagtacaaatcaggctttttcccaaggaaggcaaaccatgataactgtcctatatgtctatccgctttcagacgccgagaaacactcattacattggcttgcaagcatagttaccatgaaggttgtattgctagatggctcaagattgacaagaggcctgcccagtttgcaaatatgaagtgtttggaccttcctagcgtgtga

SEQ ID NO: 334 - protein, 267 aa, Oryza sativa
  misc_feature (254)..(254): Xaa = any naturally occuring amino acid
MATVGQPDAHERITVHYVNPPPIAGAGEAHVDGLDDEVLDYVIGDVLQDQREGLYQSILYGKYGDDMRGARNTALAQSDGLHYYYHGENSSGEATTSRNSEIDQQIEYDLVFARQLQAMDNLTNLRHLQMKMMDSDISCVPSPSDSETDEPAEGNNEEAATQDDNDDPDNMTYESQRQALVESVGNENRGLSDLLISYLETWKYKSGFFPRKANHDNCPICLSAFRRRETLITLACKHSYHEGCIARWLKIDKXACPVCKYEVFGPS

SEQ ID NO: 335 - DNA, 1290 bp, Oryza sativa
  misc_feature (529)..(529): w = adenine or thymine
atgagttacagaaatggagatattaggatgaaatcatcccatctccatggaatcaatccgacaagcacgccgccgtcgaggcctcatactaatacttctccggccattgacggcgtcggcggcggcgacgttattgataccaaaacgacacaacaacatcatcatcatcatcggcgttggatggcggcgcgctgccgcgaccttctcctccgtcagcagcgccgaacctcttcccgccgccgccacgctgctccgccgccgccatcggattcggccgcgcctcctcccgcgccgccggctgcgcgtcgatgtagtcgggctgccccgaccaccccagcagcggcgcccaccacttcccgccgcctccgcctccgcctccgccaccgctcccgtcgccgcggaacctcgccgcgccggcggccgacgcggaacgccgcgacgcacggcctcgccgccgccggcaaaggcctcaccgagaaagccgccccgatgcaatcgccattggatttgcttctcttccaacaacaawtcaatcagaatatccccccaagcttcttcgattcgattcgattcgatttggattcctccctccgaattttgaagtggatcgacgaggctgtggattggaggaggtgggattttattgcgggggaagaggaggagggagacgaacgagtggataaggttgcgtgggggctcgctcgacggcgacaccggccatcgacgacgcggacagatatttcggtccccggcgcgcacgcggggcgtgaaccggtccagcgcacccgggccaccggtctccctctcctctcctcccctcccgcgcgccgcgagagcaacctcccgtgtccactagctcgctcgcggtcttcgctcgccgtcgctgccaatggcatagtacacttctgctcccgcgcgcctggaaggtggctcacggatcgatcggcacgcaccggccgtttccacgtacgcgaccgtttccggccgcgtcgcgctgttcatatgtacgcctgcctcgcccggccgtgtcgtcgtcgtcgtggaacttgtggaataattcgctcagctaaagggggatcgatcgatgggctggagggcgaggctcaaggggcgatgtcgctttccaggatagataagataacagcaacgaattcacgtgctgctgcttggcaagtggcaacgcaacgagaagcgacgctttcaagcaaacttggagctgatctggaacgcccatctcacacacgcacggaagcggaccggtgcactgcacacgacttgggccctgtttag

SEQ ID NO: 336 - protein, 428 aa, Oryza sativa
MSYRNGDIRMKSSHLHGINPTSTPPSRPHTNTSPAIDGVGGGDVIDTKTTQQHHHHHRRWMAARCRDLLLRQQRRTSSRRRHAAPPPPSDSAAPPPAPPAARRCSRAAPTTPAAAPTTSRRLRLRLRHRSRRRGTSPRRRPTRNAATHGLAAAGKGLTEKAAPMQSPLDLLLFQQQNQNIPPSFFDSIRFDLDSSLRILKWIDEAVDWRRWDFIAGEEEEGDERVDKVAWGLARRRHRPSTTRTDISVPGAHAGREPVQRTRATGLPLLSSPPARRESNLPCPLARSRSSLAVAANGIVHFCSRAPGRWLTDRSARTGRFHVRDRFRPRRAVHMYACLARPCRRRRGTCGIIRSAKGGSIDGLEGEAQGAMSLSRIDKITATNSRAAAWQVATQREATLSSKLGADLERPSHTRTEADRCTAHDLGPV

SEQ ID NO: 337 - DNA, 675 bp, Oryza sativa
  misc_feature (15)..(15): y = cytosine or thymine
atggcggaccagctytccgaagagcagattggagagttcagggaggccttcagcctcttcgacaaggacggcgacgggttctatcaccaccaaggagctaggaaccgtgatgcgaagtctagggcagaacccaacggaggcggagctgcaggacatgatcagcgaggtggacacggacagcaacggcaacatcgaattcaaggagttcctgggcctgatggcgcgcaagctgagggacaaggactccgaggaggagctgaaggaggcattccgcgtcttcgacaaggaccagaacggtttcatctctgccaccgagctccgccacgtgatggccaacatcggggagcggctcaccgacgaggaggtcggcgagatgatcagcgaggccgacgtcgacggcgacgggcagatcaactacgaggagttcgtcaagtgcatgatggccaaggaagaggaggaagaggatagaggagaagagggaccacgacggcggcagcaggacgaagagtgcagggccctccgccgcgccggcgagcaagcgtggccagaagtgcgtgatcctgtaataattgagccagcactgagattctcatgagtcaatgagctacacgaatgatgtgtgttgttgtaaaatggcaaaacaattgtgtgggcgtgtagtatgatgctccactg

SEQ ID NO: 338 - protein, 187 aa, Oryza sativa
MADQLSEEQIGEFREAFSLFDKDGDGSITTKELGTVMRSLGQNPTEAELQDMISEVDTDSNGNIEFKEFLGLMARKLRDKDSEEELKEAFRVFDKDQNGFISATELRHVMANIGERLTDEEVGEMISEADVDGDGQINYEEFVKCMMARKRRKRIEEKRDHDGGSRTKSAGPSAAPASKRGQKCVIL

SEQ ID NO: 339 - DNA, 1308 bp, Oryza sativa
atggcgtcgtcgtccgtcttcgctggcctcgcgcaggcgccggaggaccccatcctcgggggtgacggtcgcgtacaacaaggatcccagccccgtgaaggtcaatctcggcgtcggcgcctaccggaccgagaggaagggaagcccctggtgctgaatgtggtcaggcgcgctgagcagatgctgatcaacaacccgtcacgtgttaaggagtatttgccgatcactggactggccgatttcaataagctgagtgctaagcttatttttggtgctgacagacagtcctgccattcaagagaatagggtggctacagttcagtgcttgtcaggaactggttctttaagggtgggaggtgaatttcttgcaaggcattatcatgaacgcactatatacatcccacagccaacctgggggaatcaccccaaagtgttcactttagctggcctgactgttaggagttaccgctactatgatcctgcaacccgtggactggatttccaagagggctgttagaagatctcggttcagctccttcaggtgcaattgtactgcttcatgcttgtgcccacaaccctactggagtagacccaactttggaccagtgggaacagatcaggcagttgatgagatcaaaagcattgctgccattctttgatagcgcttatcagtcagggatttgcaagtggaagtcttgaccaagatgctcaatcagtgcgcatgtttgttgctgatggtggtgaattgctcatggctcagagctacgctaagaacatgggattgtatggagagcgtgtcggtgctttaagcatagtttgtggaagtgctgatgtagctgtcagggttgaaagtcaacttaagcttgtaattaggcctatgtattcaaaccctcctattcatggtgcatctatcgtggctaccatacttaaggacagtagtgcaatgttcaatgaatggactgtggagctgaagggcatggctgataggattattagcatgaggcaacagctttttgatgctctgaaaacgagagagaaactcctggagactggagtcacatcattaagcagatcggaatgttcactttcactgggctcaacagtgatcaagtggctttcatgaggcaggaataccacatttacatgacatctgatggggaggatcagtatggctggtttgagcgggaggaccattccgcatcttgcagatgcaatccatgccgcagtcacaaaactgaagtgaatgatggtagcatagcagctccctccaagaataacatcttaaaaccatccgcagcagtgttctga

SEQ ID NO: 340 - protein, 413 aa, Oryza sativa
  misc_feature (44)..(44): Xaa = any naturally occuring amino acid
  misc_feature (169)..(169): Xaa = any naturally occuring amino acid
  misc_feature (344)..(344): Xaa = any naturally occuring amino acid
MASSSVFAGLAQAPEDPILGVTVAYNKDPSPVKVNLGVGAYRTXEEGKPLVLNVVRRAEQMLINNPSRVKEYLPITGLADFNKLSAKLIFGADDSPAIQENRVATVQCLSGTGSLRVGGEFLARHYHERTIYIPQPTWGNHPKVFTLAGLTVRSYRYYDPATRGLDFQXGLLEDLGSAPSGAIVLLHACAHNPTGVDPTLDQWEQIRQLMRSKALLPFFDSAYQQGFASGSLDQDAQSVRMFVADGGELLMAQSYAKNMGLYGERVGALSIVCGSADVAVRVESQLKLVIRPMYSNPPIHGASIVATILKDSSAMFNEWTVELKGMADRIISMRQQLFDALKTXRETPGDWSHIIKQIGMFTFTGLNSDQVAFMRQEYHIYMTSDGRISMAGLSGRTIPHLADAIHAAVTKLK

SEQ ID NO: 341 - DNA, 1577 bp, Oryza sativa
atggccggcggccgcggtggttgagcacggggggcaggccaaggactacccctggcaagctcaaccctctttcgtcttcttctacatgcgtcgtcgtccgccaccggtggtctcatcttcggatatgacatcggtatatcagtggtgtgacgtccatggacccgttccctgaggaagttcttcccggaggtgtatcggaagaagcagatggcggacaaggacaaccagtactgcaagtacgacaaaccagctgctgcagacctttcacctcgtcgctctaccttgccgccctcgtctcctccttcttcgccgccaccgtcacccgcgtcctcggccgcaagtggtccatgttcgccggcggcctcaccttcctcatcggcgccgccctcaacggcgccgccgagaacgtcgccatgctcatcgtcggtcgtatcctcctcggtgtcggtgtcggcgtcggcttcgccaatcagcagtcggtgccggtgtacttgtcggagatggcgccggctcggctgcgggggattctgaacatcgggttccagctgatgatcaccatcggcatcctggcggcggagctgataaactacgggacggcgaagatcaaggccgggtggggatggcgggtgagcctggcgctggccgccgtccccgccgccatcatcaccctcggctccctcttcctcccggacacccccaactcgctcatcgacaggggccacccggaggcggcggagcgcatgctccggcgcatccgcggctccgacgtggacgtgtcggaggagtacgcggacctggtggcggcgagcgaggagtcgaagctggtgcagcacccgtggcgcaacatcctccgccgcaagtaccgcgcccagctcaccatggccatctgcatccccttcttccagcagctcaccgggatcaacgtcatcatgttctacgcccccgtgctgttcgacaccctgggcttcaagagcgacgcgtcgctcatgtccgccgtcatcacgggcctcgtcaacgtcttcgccacgctggtgtccatcttcaccgtggaccgcctcggccgccgcaagctgttcctgcagggcggggcgcagatggtggtgtgccaggtggtggtggggacgctgatcgccgtcaagttcgggacgagcggcatcggcgacatccccaaggggtacgcggcggtggtggtgctcttcatctgcatgtacgtggcagggttcgcgtggtcgtggggcccactggggtggctcgtccccagcgagatcttcccgctggagatccggccggcggggcagagcatcaacgtgtcggtgaacatgctcttcaccttcgtcatcgcgcaggccttcctcaccatgctctgccacatgaagttcggcctcttctacttcttcgccggatgggtcgtcatcatgaccgtcttcatcgccctcttcctccccgagaccaagaacgtccccatcgaggagatggtgctcgtctggaagtcccactggttctggcgccgattcatcggagaccacgacgtccacgtcggcgccaaccacgtctccaacaataagctccaaccataa

SEQ ID NO: 342 - protein, 525 aa, Oryza sativa
  misc_feature (47)..(47): Xaa = any naturally occuring amino acid
  misc_feature (86)..(86): Xaa = any naturally occuring amino acid
  misc_feature (385)..(385): Xaa = any naturally occuring amino acid
GRRPRWLSTGGRPRTTPGKLNPLFVFFTCVVSATGGLIFGYDIGISXGVTSMDPFLRKFFPEVYRKKQMADKDNQYCKYDKPAAAXPFTSSLYLAALVSSFFAATVTRVLGRKWSMFAGGLTFLIGAALNGAAENVAMLIVGRILLGVGVGVGFANQQSVPVYLSEMAPARLRGILNIGFQLMITIGILAAELINYGTAKIKAGWGWRVSLALAAVPAAIITLGSLFLPDTPNSLIDRGHPEAAERMLRRIRGSDVDVSEEYADLVAASEESKLVQHPWRNILRRKYRAQLTMAICIPFFQQLTGINVIMFYAPVLFDTLGFKSDASLMSAVITGLVNVFATLVSIFTVDRLGRRKLFLQGGAQMVVCQVVVGTLIAVKFGTSGXIGDIPKGYAAVVVLFICMYVAGFAWSWGPLGWLVPSEIFPLEIRPAGQSINVSVNMLFTFVIAQAFLTMLCHMKFGLFYFFAGWVVIMTVFIALFLPETKNVPIEEMVLVWKSHWFWRRFIGDHDVHVGANHVSNNKLQP

SEQ ID NO: 343 - DNA, 981 bp, Oryza sativa
atggcggcggatcctgcagccattgttcttcccagcgagggcgacgacgccgatggcatggttcttcttcgagacggcagtgacggcctcccgccgctcaaggtagaccgcgagacgcacaggcaagtgctgctcaggttctacatggcctgctgcatctccgacttcaagcacgacatcagggagctcgtggaggcctacctgaagccctgccatgagctggagctggaatggacgcggcagctctccgccgaccgcaccgccgccatggaccacctgctcttcgtcggcctcgacgccaccgagccgcctgagccgcagcagcagctgcaggaggaggaggaggaggacccgccggtgagcgcggccgggttcgtggaccgggtgcacatgcggaggatgatccaggccttcttccacccggacatggccgacgtggaggacgaggggaaggacacgcgcatcgaccggagcttgatggccaacttcatggccgccaccggcttcgtcaaccgcctgtgggacgcgcgcaggatcatcgccgtgtgccgcgacggcggcatggacgacgccgcgcgcgaggcggccgcggcggggatgctgcgtcggctggaggagttgctcaacggtcgagccaaggcggggcacctgtgcgtcgccgtcgcactgaagcaggcggtgtgctgtgttcccaactccaatctcgttccccacttccaatccccctcaaatccatccccaaccccgtttcagcacctcagtgcgacagttgcagtatgccacgcgcgggcgccgctgccaccagatgacaaggaggacggcaacgtgccatgtgcgtgtgtcctcctgaacgcccgcggcgacggcattcctacactggtcgacaggatcgtctccgatgagggcttcttgctccgccatctgctgagtgagcacgtgcctatcgggcaattccgtgtccgcaagttcaggcttatataa

SEQ ID NO: 344 - protein, 326 aa, Oryza sativa
MAADPAAIVLPSEGDDADGMVLLRDGSDGLPPLKVDRETHRQVLLRFYMACCISDFKHDIRELVEAYLKPCHELELEWTRQLSADRTAAMDHLLFVGLDATEPPEPQQQLQEEEEEDPPVSAAGFVDRVHMRRMIQAFFHPDMADVEDEGKDTRIDRSLMANFMAATGFVNRLWDARRIIAVCRDGGMDDAAREAAAAGMLRRLEELLNGRAKAGHLCVAVALKQAVCCVPNSNLVPHFQSPSNPSPTPFQHLSATVAVCHARAPLPPDDKEDGNVPCACVLLNARGDGIPTLVDRIVSDEGFLLRHLLSEHVPIGQFRVRKFRLI

SEQ ID NO: 345 - DNA, 1782 bp, Oryza sativa
atggctcctatgtgctatgtgttgagagctggggctttggcgcagtcaagctgctgtgagaagaacaaagcaaagcaatgcatcaggatcggcagcgccaccgcttatgtagctatgtgtggaatacaagtacccgggtacccaaggagaggcctttgggccgtacggcataggattgatgcgcgggtatttcttgctttcatgtcccgacgatctggccatccgccgcacgttggaaaaagcagttcgctgccaggacgagatcaacaggttttggccgtactgcaaatcgccgcgaccgcgaagcgaggcgaggcggccttgccgccaaccgcgcaagccgtgggcaatgcacctgtccacaccgagggcacgcacggccgcacgcgggagtgcgagaccaccggccgccagccgccagctgccagcgcacgacatcgcgtgacgtcgcttgttgtttcccctttttgttttgcacgcacgctcggggcactacgccgcacattgggaacttcatccattacccggctggcgcggctcgactgtgcccggggcacacctgcgttgtctgggcgctctacaccgacccgccacagactcgagggctttgcatctcccgttgtccgggcactccacgtcgactcaccacagatccgggggcttcgcatcccccatcgaccgtggactccacgccgactcaccacggacccgggggggtttacatcccctatcgtccgtgcactcctcgccgactcaccacggatccaggggcttcgcctccgtcgtccaggtgcccttcgccgacctcgccacggactcggggggcttaacctccctcgttgtccgggcgctctacaccgacttcgctatggactcgggggcttcgcatcctccgtcgtcctggcactccacgccgacccaccatggactcgagggcttcgcctctcccgtcgtccgggtgccctatgccgacttcatcacggactcaggggcttcgcctccctcgtcatccgggtgcccttcgctgacctcgctacggactcaggggcttcgtctcccccgttgtctaagcgctttacgccgacccgccacggacttgggggctccgccttcctttctacccgggcgttctacgccgaccttaccacgaactcagggacttcgcctcccttgtcgtccgggtgttcttcgctgacccgctacgggctagggggcttcgcctccctcgttgtccaggagctctgcaccgactctgccacggactcaggggcttcgccccctcgttgtccgggcgctctgcaccgactccgccacgggctcgggggcttcgcctccctcgttgtctgggcactctacgcggactttgccacgtactcgggggcttcgcctacctcgttgttcaggctcaggggcttgacacccctcattgcctggggtactactcgccgacaccgggacggctactgcgttttcgaacgaaggcttgcacctccaagccgaccgcatacgccgccgccgggtgatctgctccccgcgcaggacgactactgtgttatcgactggaggcttgcaccttcgggccgaccgcatacaccgcctcagggtgatccgttccccgcgcaggacggctactgcattgccgatcggaagcttgcaccttcgagccaaccgcctacaccgccgccaagtgatccgctccttgcggaggatagccggacgtctacgtcgatgcctagcgacttcctccccatgcaccatggctgcttcaccgccactgactga

SEQ ID NO: 346 - protein, 593 aa, Oryza sativa
MAPMCYVLRAGALAQSSCCEKNKAKQCIRIGSATAYVAMCGIQVPGYPRRGLWAVRHRIDARVFLAFMSRRSGHPPHVGKSSSLPGRDQQVLAVLQIAATAKRGEAALPPTAQAVGNAPVHTEGTHGRTRECETTGRQPPAASARHRVTSLVVSPFCFARTLGALRRTLGTSSITRLARLDCARGTPALSGRSTPTRHRLEGFASPVVRALHVDSPQIRGLRIPHRPWTPRRLTTDPGGFTSPIVRALLADSPRIQGLRLRRPGALRRPRHGLGGLNLPRCPGALHRLRYGLGGFASSVVLALHADPPWTRGLRLSRRPGALCRLHHGLRGFASLVIRVPFADLATDSGASSPPLSKRFTPTRHGLGGSAFLSTRAFYADLTTNSGTSPPLSSGCSSLTRYGLGGFASLVVQELCTDSATDSGASPPRCPGALHRLRHGLGGFASLVVWALYADFATYSGASPTSLFRLRGLTPLIAWGTTRRHRDGYCVFERRLAPPSRPHTPPPGDLLPAQDDYCVIDWRLAPSGRPHTPPQGDPFPAQDGYCIADRKLAPSSQPPTPPPSDPLLAEDSRTSTSMPSDFLPMHHGCFTATD

SEQ ID NO: 347 - DNA, 1284 bp, Oryza sativa
  misc_feature (297)..(297): s = guanine or cytosine
  misc_feature (337)..(337): k = guanine or thymine
  misc_feature (341)..(341): r = adenine or guanine
atgaatgggtgcggcgcggcggtggcgggggcgggggcggtggcggtgcgggagacgcgggcgttgccggcggcgggcgcggcgggggacgccgtggggcagctcagggaggcggtggcggcgctggaggccgccgacccgccggcgtcgccctccggcatcatccgcatcgaggtgcccgtccggcagcgaggggacgccgtggagtggctgcacgcgcagggcgacctgcgcgcgcgctgcttcttctccgcgcgtgccgccgctcccttgcccgagtgcccggccctcgccatsgcctccgccggcaacggcaacggcaacggagcaggcggcktcgraggggagcagcggcagcggccggtgagcgtcgccggcgtcgggtccgccgtgttcttccgcgggaccgagccgttctccctccgcgactggcgcgccatcaagagccactgattcgtgcttatggtgctatccgcttcgatgccacgagcgatcattcagttgaatgggaggaatttggatcattttacttcattgttcctcaagttgagtacaatgagcttgaagagagctcggttctcgcaacgacgattgcatgggatgattcactttcttggacatggcaaaatgctgtgaaggagctccaatcaactttgcagaagatatttactgatacttgcattgaccctgttgaactgttggcatgtttaaaggagggccaaaatgcttatcagttctgtatacagccacctgatgctcctgcatttgttggaaatagtgtatccagagcaattatttcatcggaaatacttaaacatttccagcgaggctttagctggtacacgagcaagggggaaaacaagggctgatgactttcaaattggtcaagatttgctactaagatctgcgatgatgtggttgtccatcccagcaaggcccttcggaaacttccaagagtacaacacctgtcagctcagttagctgcaagaatgaggaatgaagacgatgagatcctaaatactcttcatccgagcccagccgtttgtggtctgcccactgaagaggcacgccaattcatacaagattatggaaatttttgaccgtggaatgtatgctggacctgttggttggtttggaggagctgaaagtgagttcgctgttgggattagatcagcactactaggaaaattagtttatgctggtgccggaattgttgaaggtacaaatccatcctttgaatgggatgagcttgacctcaaagcatctcaggtattattggtctaa

SEQ ID NO: 348 - protein, 427 aa, Oryza sativa
  misc_feature (99)..(99): Xaa = any naturally occuring amino acid
  misc_feature (113)..(114): Xaa = any naturally occuring amino acid
MNGCGAAVAGAGAVAVRETRALPAAGAAGDAVGQLREAVAALEAADPPASPSGIIRIEVPVRQRGDAVEWLHAQGDLRARCFFSARAAAPLPECPALAXASAGNGNGNGAGGXXGEQRQRPVSVAGVGSAVFFRGTEPFSLRDWRAIKSLIRAYGAIRFDATSDHSVEWEEFGSFYFIVPQVEYNELEESSVLATTIAWDDSLSWTWQNAVKELQSTLQKIFTDTCIDPVELLACLKEGQNAYQFCIQPPDAPAFVGNSVSPEQLFHRKYLNISSEALAGTRARGKTRADDFQIGQDLLLICDDVVVHPSKALRKLPRVQHLSAQLAARMRNEDDEILNTLHPSPAVCGLPTEEARQFIQDYGEIFDRGMYAGPVGWFGGAESEFAVGIRSALLGKLVYAGAGIVEGTNPSFEWDELDLKASQVLLV

SEQ ID NO: 349 - DNA, 1599 bp, Oryza sativa
atggcgggatcgcagctcaacgttttggtcaagctcgaccaggccaagacgcaatggtaccatttcatggcgatcgtcatcgccgggatggggttcttcacagacgcctacgacctcttttgcatcgcgctggtcaccaagctgttgggtcgcctttactacaccgacatcaccaagcccaacccagggacactcccgcccaacgtgtcgtccgccgtcaccggcgtcgcgctctgcggcacgctcgccggccagctcttcttcggatggctcggcgacaagctcggccgcaagagcgtctatggaatggtcgtgtgctccatcgcctccggtctctcgtttggccacacgcccaagagcgtgattgccacgctctgcttcttccgcttctggctcggcttcggcatcggcggcgactacccgctcagcgccaccatcatgtcggagtacgcgagcaagaagacccgcggggccttcatcgccgccgtgttcgccatgcaggggttcgggatcctcttcggcgccatcgtcgcgctcgtcgtctcggccggcttccgtcacgcgtacccggcgccgtcgtacgcccagaaccccgccgcgtcgctcgcgccgcaggctgactacacgtggcggctcatcctcatgttcggcaccatcccggctgggctcacctactactggcgcatgaaaatgcccgagacggcgcggtacacggcgctcgtcgcccgcaacgccaagcaggcggcggctgacatgtccaaggtgctccacgccgagatcgaggagcggccggaggtggtcgagagccaggtggtcgccggggagacctggggcctcttctcacggcagttcatgaagcgccacgggatgcacctcctggcgaccaccagcacgtggttcctgctcgacatcgccttctacagccagaacctgttccagaaggacatcttcagcaaggtcgggtggataccgccggcgaagaccatgaacgcgctcgaggaactctaccgcatctcccgcgcccaggcactcatcgcactctgcggaaccatcccgggctactggttcaccgtcgccttcatcgacatcgtcggcaggttctggatccagatcatgggcttcttcatgatgaccgtgttcatgctcgcgctcggcgtgccctacgaccactggacgcacccggcgcaccacaccggcttcgtcgtgctctacgcactcaccttcttcttcgccaacttcgggcccaacagcaccaccttcatcgtgccggctgagatcttcccggcgaggctccggtcgacgtgccacggcatctccgccgcgtccggcaaggccggcgcgatcatcggcgcgttcgggttcctgtacgctgcgcaggaccagcacaatcccgacgcgggatactcccgcggcatcggcatccggaacgcgctcttcgtgctcgccggcacaaacttcctcggtatgctcatgacgctgctggtgccggagtccaagggcttgtcgctggaggagatgtccaaggacaacgtcgtcgacgagaccgcccaagaagcgatcgcccaagcgtgatgtcataaacatgccgtctcgacgtga

SEQ ID NO: 350 - protein, 523 aa, Oryza sativa
MAGSQLNVLVKLDQAKTQWYHFMAIVIAGMGFFTDAYDLFCIALVTKLLGRLYYTDITKPNPGTLPPNVSSAVTGVALCGTLAGQLFFGWLGDKLGRKSVYGMVVCSIASGLSFGHTPKSVIATLCFFRFWLGFGIGGDYPLSATIMSEYASKKTRGAFIAAVFAMQGFGILFGAIVALVVSAGFRHAYPAPSYAQNPAASLAPQADYTWRLILMFGTIPAGLTYYWRMKMPETARYTALVARNAKQAAADMSKVLHAEIEERPEVVESQVVAGETWGLFSRQFMKRHGMHLLATTSTWFLLDIAFYSQNLFQKDIFSKVGWIPPAKTMNALEELYRISRAQALIALCGTIPGYWFTVAFIDIVGRFWIQIMGFFMMTVFMLALGVPYDHWTHPAHHTGFVVLYALTFFFANFGPNSTTFIVPAEIFPARLRSTCHGISAASGKAGAIIGAFGFLYAAQDQHNPDAGYSRGIGIRNALFVLAGTNFLGMLMTLLVPESKGLSLEEMSKDNVVDETAQEAIAQA

SEQ ID NO: 351 - DNA, 756 bp, Oryza sativa
  misc_feature (261)..(261): y = cytosine or thymine
atgagcaacaccaccatggctatttccaccatccttctcttcctcctcgccggcctcgtcgccgcccacggcgacggcgacaccatgatccgtctcccaagcgacggcgccgaagcaccaccacgcccgcccaaaccctgggactgctgcgacaacatcgagatgtccccgctcgagatcttcccgccgctgtaccgctgcaacgacgaggtgaagcagtgctccgccgcctgcaaggagtgcgtggaggcgcccggcgayttcccccgcggcgccttcgtgtgccgcgactggtactcgacggtggacccgggccacatgtgcacggcgccggatcagccgacgacgaagaggccgtggaagtgctgtgacagcatcgtgcagctgccgcagaggatcttcccgccgttctggcgctgcgacgacgagctggagcccggcaagtgcaccgccgcgtgcaagtcgtgcagggaggcgccggggccgttcccggggccgctcatctgcgaggacgtctactggggcgccgacccgggccccttgtgcacgccgcggccatgggggaaatgctgcgacaaggccttctgcaacaagatgaacccgccgacctgccgctgcatggacgaggtgaacaagtgcgccgccgcgtgcaaggattgccagcgtgtggagtcgtcagagccgcctcgctacgtctgcaaggaccgcttcaccggccagcccgggcccatgtgcaaaccccgagcggagaactag

SEQ ID NO: 352 - protein, 250 aa, Oryza sativa
MSNTTMAISTILLFLLAGLVAAHGDGDTMIRLPSDGAEAPPRPPKPWDCCDNIEMSPLEIFPPLYRCNDEVKQCSAACKECVEAPGFPRGAFVCRDWYSTVDPGHMCTAPDQPTTKRPWKCCDSIVQLPQRIFPPFWRCDDELEPGKCTAACKSCREAPGPFPGPLICEDVYWGADPGPLCTPRPWGKCCDKAFCNKMNPPTCRCMDEVNKCAAACKDCQRVESSEPPRYVCKDRFTGQPGPMCKPRAEN

SEQ ID NO: 353 - DNA, 615 bp, Oryza sativa
atggcggtggtcgagcagccgcagcagcaggtggtgaagctcttcaactgctggtccttcgaagacgttcaggtgaacgacatatccctcgccgactacctcgcggtgtcctcgacgaagcacgccacctacctgccgcacacggctggccgctactcggcgaagcgcttccgcaaggcgcagtgccccctcgtggagcgcctcaccaactccctcatgatgcacggccgcaacaacggcaagaagatcatggctgtccgcatcgtcaagcacgccatggagatcatccacctcctcaccgacgccaaccccatccaggtcatcgtagatgccatcatcaacaggttcacagcggcccgcgtgaggacgcaacccgtatcggctctgctggcgctgtgaggaggcaggctgtggatatctctcccttgaggagggtcaaccaggcaatctacctcctcaccactggcgccagggagagtgcctttaggaacatcaagaccattgctgagtgccttgctgatgagctcatcaatgccgccaagggctcatccaacagacagctatgccatcaagaagaaggatgagattgagcgtgttgccaaggcgaaccgttga

SEQ ID NO: 354 - protein, 204 aa, Oryza sativa
MAVVEQPQQQVVKLFNCWSFEDVQVNDISLADYLAVSSTKHATYLPHTAGRYSAKRFRKAQCPLVERLTNSLMMHGRNNGKKIMAVRIVKHAMEIIHLLTDANPIQVIVDAIINRFTSGPREDATRIGSAGAVRRQAVDISPLRRVNQAIYLLTTGARESAFRNIKTIAECLADELINAAKGSSNRSYAIKKKDEIERVAKANR

SEQ ID NO: 355 - DNA, 705 bp, Oryza sativa
atggcgcagaggacgctggagctgacgctgatctcggccaaggatctcaaggacgtgaacctcctctccaagatggaggtctacgccgtcgtctcgctctccggcgaccgccgctcgcggcagcggatcgccaccgaccgcgccggtggccgcaacccggcgtggaacgccgccccgctccggttcaccgtcccggcctccggcgcgggttccctccacgtcctcctccgcgccgagcgcgccctcggcgaccgcgacgtcggcgaggtccacatccccctctcggagctcctctccggcgcccccgacggcgccgtccccgccaagttcgtctcctaccaggtccgcaagatctcctccgggaagccacagggcgtcctcaatttctcctacaagatcggcgagtacggctacgggtacccggcccagccgccgccgccgcaagccggctacggctacccacccccgccgccgcaagccggctacggcggcggctacggctacccgccgcaggctgggtacggcggctaccagcagcaggccgtgaagccggcgaagaagaacaacttcgggatgggactcggagccgggctgctcggcggcgcgctcggcggcctcctcatcggagacgccatctccgacgcgtcggcgtatgacgccggctacgacgcagggttcgacgacggcggtggcttcgatttctag

SEQ ID NO: 356 - protein, 234 aa, Oryza sativa
MAQRTLELTLISAKDLKDVNLLSKMEVYAVVSLSGDRRSRQRIATDRAGGRNPAWNAAPLRFTVPASGAGSLHVLLRAERALGDRDVGEVHIPLSELLSGAPDGAVPAKFVSYQVRKISSGKPQGVLNFSYKIGEYGYGYPAQPPPPQAGYGYPPPPPQAGYGGGYGYPPQAGYGGYQQQAVKPAKKNNFGMGLGAGLLGGALGGLLIGDAISDASAYDAGYDAGFDDGGGFDF

SEQ ID NO: 357 - DNA, 216 bp, Oryza sativa
atgtcgctgacgtggagcagccactggttgtttctattggcccaggtgaacatctccttgctggttaaggtgctgcccagcgtccagcagcgaggcccgaagcagtgccttcgcctcaaccgccgcctgccaccgccatcaaccgctacggtgtcgtcgtcctcctctatggcagatgatgtgaaccctggttggactaccttcactgtgagctga

SEQ ID NO: 358 - protein, 71 aa, Oryza sativa
MSLTWSSHWLFLLAQVNISLLVKVLPSVQQRGPKQCLRLNRRLPPPSTATVSSSSSMADDVNPGWTTFTVS

SEQ ID NO: 359 - DNA, 2322 bp, Oryza sativa
atgggtgcgcggtgggggcctcgccgcgccaccgtcgggccccacctccgcgacgcgctgcgtcacctgctcttcgtcttcctcgtgctgctccaggcgcaggcggggcgcggcggcgccacgctcaacggcgaaggtaacggccccagaggagcagcttgccatggtggtggaatggcgttgctcgagctgagggagagggtggaggctgacccccatggcgccttgcgggattgggatccggcagacgccacgccctgcagatggaacttaacaggccgagaattggtgggaactctcgcacctgagattggacgtcttcaacttttgaaatctctcattcttcgaaacaacaatttccgtgggaaaattcccaaagagttcggagggttaactgcccttgaagtactggatttgagcagcaacaacttggatggaacgattccagaagaattaatggcaatgccactgctcaagcagctgtcacttcatgacaatcagttccaagatgatatctcttctttgcacattcaagatatatctgatgagcaggcaggatgcttgagcagaaaattaggttgctgggcggggtttaaggattggacttctttcagtgatctccgagagaaatactccaccaacctagcaagtctaggcgagccacacattatgcaaaatttgcagtcctttgcaagtgccgtgggccgcaggctgctcggtgaagttggcaatctgcctgccctttcagggaattatgctaaatcttctggccctgtaaattcagaagagatccaaagggctattgatgttctctctttagggagtggttcattctctgcattcccaaattcagaggccgaagttctggaatcagctgtaaatactgatgctgctgcaatgcagtctggagcagcaaatcaatcaaccgatgaagtgtctggttcaaagcacagcaagtgggcatattttatgataattccagctgcaatattgctgattagcctgattgtggctccaatcttggtctggcggaagcgagggcgtgcggcaataggaccttggaaaacgggtctaagtggcccacttcagaaagcatttgtaacaggtgttccaaagctaaacagacctgaactcgaagccgcttgtgaggatttcagtaacataatcaacactttccctagctgcaccgtgttcaaagggacattatctagcggagttgagatcagtgttgtttccactgccattttgtcgctcaaagagtggcctaagagttcagagacatgcttcagaaaacagatagacacactatcaagagtaaaccacaagaatttcatcaacctcctaggttattgcctggaaaatcaacccttcatgagaatgatggtgttcgagtatgctccaaatggcactctctctgagcatctccacctcaaagaatttgagcatctggactgggctgcaaggatgaggatcatcatgggtgtggcatactgtctccaatacatgcaccatgatctcaatccacctgttgcgataaccgacatgcgctccgacacaattttcatgacagatgattatgctgccaagattgctgatgttggtatctggaaagaagtcgccataaaagcaaagactgcaaaggaggatagcagcagccgttctgaatgtcctcctgatatcgcgagcaacgtctactgctttggcacgcttctgatagagatcatatccggaaagctccctgaagcagacgaccaaaaatccatgtgcaactgggccgctgagtatctgaagggcaagagctacagcaagctcgtcgacgcgtcgctgaaggaacacaacgccaacgagctggaggccgtctgcgaggtgattcaggagtgcattgatcccgactcagatcagaggccgacgatgagagacgccacccgcaagctgagacaagctctcaacatctcgccggaggcagcgacgccgcggctctcgcctctctggtgggctgagctcgagatactctctgcagaggcaacctacgatagcgttgattacttgagcggtatcgctgtttgcttgagcgagaccgcgcggtctcgcaccggaaccgcgcgagaccgtgcgggtctcatgtacacgataatcgtgttcagagaacgccagaatgggacggattggaagctagctaaatatctgaagccaaccaaatgtcccattttcgctcaccgcgtgtatcctgcgagaaccttgacgtttgtggcaaactggcaacctaaccgtgaggcctgccttggctcgtacaccctgacgagttcttctcacaaaaaatga

SEQ ID NO: 360 - protein, 773 aa, Oryza sativa
MGARWGPRRATVGPHLRDALRHLLFVFLVLLQAQAGRGGATLNGEGNGPRGAACHGGGMALLELRERVEADPHGALRDWDPADATPCRWNLTGRELVGTLAPEIGRLQLLKSLILRNNNFRGKIPKEFGGLTALEVLDLSSNNLDGTIPEELMAMPLLKQLSLHDNQFQDDISSLHIQDISDEQAGCLSRKLGCWAGFKDWTSFSDLREKYSTNLASLGEPHIMQNLQSFASAVGRRLLGEVGNLPALSGNYAKSSGPVNSEEIQRAIDVLSLGSGSFSAFPNSEAEVLESAVNTDAAAMQSGAANQSTDEVSGSKHSKWAYFMIIPAAILLISLIVAPILVWRKRGRAAIGPWKTGLSGPLQKAFVTGVPKLNRPELEAACEDFSNIINTFPSCTVFKGTLSSGVEISVVSTAILSLKEWPKSSETCFRKQIDTLSRVNHKNFINLLGYCLENQPFMRMMVFEYAPNGTLSEHLHLKEFEHLDWAARMRIIMGVAYCLQYMHHDLNPPVAITDMRSDTIFMTDDYAAKIADVGIWKEVAIKAKTAKEDSSSRSECPPDIASNVYCFGTLLIEIISGKLPEADDQKSMCNWAAEYLKGKSYSKLVDASLKEHNANELEAVCEVIQECIDPDSDQRPTMRDATRKLRQALNISPEAATPRLSPLWWAELEILSAEATYDSVDYLSGIAVCLSETARSRTGTARDRAGLMYTIIVFRERQNGTDWKLAKYLKPTKCPIFAHRVYPARTLTFVANWQPNREACLGSYTLTSSSHKK

SEQ ID NO: 361 - DNA, 1101 bp, Oryza sativa
  misc_feature (718)..(718): r = adenine or guanine
atgtctctctgcagactgcagccatttagcattcccctatatatatactactacgtacagcgccacgtacaggcttgcgcatatgtactgtccattgggagcctaaaattgactgaactaattattgggtctttgttgcacacttgcatctgtttctcgacagcggtacactccatcggcgtgtgttacggcgtggtcgccaacaacctgcccgggccgagcgaagtcgtgcagctgtacagatccaaggggatcgattcgatgcgcatctacttcgcggacgccgccgccctcaatgcactcagcggctcgaacatcggtctcatcatggacgtcggcaacggcaacctctcgagcttagcttccagcccctccgccgcagccggttgggtcagggacaacatccaggcctacccgggcgtctccttccgctacatcgccgtcggcaacgaggttcaaggcagcgacaccgcgaacatccttccggccatgcggaacgtcaacagcgcgctggtggcggccggcctcggcaacatcaaggtatccacgtcggtcaggttcgacgcgttcgccgacaccttcccgccctccagcggcaggttcagggacgactacatgaccccgatcgcgaggttcttggccaccaccggcgcgccgctgttggcgaacgtgtacccctacttcgcctacaaagacgaccaggaaagcgggcagaaaracatcatgctcaactacgccaccttccagccgggcacgacggtggtggacaacgggaacaggctgacctacacgtgcctcttcgacgcgatggtcgactccatctacgccgcgctggagaaggccggcacaccgagcgtcagcgtcgtcgtgtccgagagcgggtggccgtccgccggagggaaggttggggccagcgtgaacaacgcgcagacatacaaccaggggctgatcaaccatgtccgaggcggcacgcccaagaagcgcagggcgttggagacttacatatttgctatgttcgacgagaacggcaagcctggggatgagatcgagaagcactttgggctgttcaaccccaataagttcgccatcgtacagcattag

SEQ ID NO: 362 - protein, 366 aa, Oryza sativa
  misc_feature (240)..(240): Xaa = any naturally occuring amino acid
MSLCRLQPFSIPLYIYYYVQRHVQACAYVLSIGSLKLTELIIGSLLHTCICFSTAVHSIGVCYGVVANNLPGPSEVVQLYRSKGIDSMRIYFADAAALNALSGSNIGLIMDVGNGNLSSLASSPSAAAGWVRDNIQAYPGVSFRYIAVGNEVQGSDTANILPAMRNVNSALVAAGLGNIKVSTSVRFDAFADTFPPSSGRFRDDYMTPIARFLATTGAPLLANVYPYFAYKDDQESGQKXIMLNYATFQPGTTVVDNGNRLTYTCLFDAMVDSIYAALEKAGTPSVSVVVSESGWPSAGGKVGASVNNAQTYNQGLINHVRGGTPKKRRALETYIFAMFDENGKPGDEIEKHFGLFNPNKFAIVQH

SEQ ID NO: 363 - DNA, 1159 bp, Oryza sativa
atgtttttttttctgatttttttggtgaattttctggtggtgtttttggggacgcaggcaagattaagatcggaatcaacgggtttcggaaggatcgggaggctcgtggccagggtggccctccagagcgaggatgtcgagctcgtcgccgtcaacgaccccttcatcaccaccgactacatggacctacatgttcaagtacgataccgtgcacggccaatggaagcacagcgacatcaagatcaaggactccaagactctgctcttgggcgagaagccggtcaccgttttcggcatcagaggaaccctgacgagattccgtgggctgaggctggtgctgagtatgtcgtggagtccaccggtgtcttcactgacaaggagaaggctgctgctcacttgaagagggtggtgccaagaaggttgtcatctctgccccgagcaaagatgctccgatgtttgtctgcggtgtcaacgaggacaagtacacttcagatattgatattgtctcaaatgctagctgcaccacaaactgccttgctcctcttgccaagtaggtcattcatgacaactttggtattatcgagggtctgatgacaactgttcatgccatcactgagccacccaaaagaccgttgatggaccgtccagcaaggactggaggggtggcagggcggccagttttaacatcattcccagcagcactggtgctgccaaaggctgttggcaaggttcttcctgatttgaatggcaagcttacgggaatgtccttccgtgttcccactgtcgatgtctcagttgttgatctcacagttagaatcgagaaggctgcctcatatgatgctatcaagagtgctatcaacaggtctgcatcagagggaaagctcaagggaatcataggatatgttgaggaagacctggtttctactgactttgttggtgacagcagcaggtcgagcatcttcgacgccaaggctggaattgctcttaacgataactttgtcaagcttgtcgcctggtacgacaacgagtggggttacagcagcaaccgtgtcatcgacctgatccgccaacatggccaagacccagtagaatccttttgcttgccatggtattccatggccgccgagccggagataccggtatgctttgtctatgctga

SEQ ID NO: 364 - protein, 385 aa, Oryza sativa
  misc_feature (184)..(184): Xaa = any naturally occuring amino acid
MFFFLIFLVNFLVVFLGTQARLRSESTGFGRIGRLVARVALQSEDVELVAVNDPFITTDYMTYMFKYDTVHGQWKHSDIKIKDSKTLLLGEKPVTVFGIRRNPDEIPWAEAGAEYVVESTGVFTDKEKAAAHLKGGAKKVVISAPSKDAPMFVCGVNEDKYTSDIDIVSNASCTTNCLAPLAKXVIHDNFGIIEGLMTTVHAITEATQKTVDGPSSKDWRGGRAASFNIIPSSTGAAKAVGKVLPDLNGKLTGMSFRVPTVDVSVVDLTVRIEKAASYDAIKSAINRSASEGKLKGIIGYVEEDLVSTDFVGDSSRSSIFDAKAGIALNDNFVKLVAWYDNEWGYSSNRVIDLIRQHGQDPVESFCLPWYSMAAEPEIPVCFVYA

SEQ ID NO: 365 - DNA, 498 bp, Oryza sativa
atgccggcggggcacgggctgcgggcgcggacgcgcgacctcttcgcgcggccgttccgcaagaagggttacatcccgctcaccacctacctgaggacgtacaagatcggcgattacgtcgacgtcaaggtgaacggcgccgtgcacaagggcatgccgcacaagttctaccacggccgcaccggccgcgtctggaacgtcaccaagcgcgccatcggcgtcgagatcaacaagcagcaggtcggtaaccgcatcatcaggaagaggatccatgtccgtgtggagcatgtccagccatccaggtgcaccgaggagctccgcctgaggaaaatcaagaacgatcagctcaaggctgatgccaaggcccgtggtgaggttatcagcaccaagagacagcccgagggacccaaacctggtttcatggttgagggtgctacgctggagactgttacccccattccgtatgatgtggtcaatgatctcaagggtggttactag

SEQ ID NO: 366 - protein, 165 aa, Oryza sativa
MPAGHGLRARTRDLFARPFRKKGYIPLTTYLRTYKIGDYVDVKVNGAVHKGMPHKFYHGRTGRVWNVTKRAIGVEINKQQVGNRIIRKRIHVRVEHVQPSRCTEELRLRKIKNDQLKADAKARGEVISTKRQPEGPKPGFMVEGATLETVTPIPYDVVNDLKGGY

SEQ ID NO: 367 - DNA, 5385 bp, Oryza sativa
atggcttgggcggaggacgaggcgattggccccgacgtggcctccgcggggctccacgtctcggagcggatcggccgcgacgccgccgctcagcccgacctggaggaggccctcgaggcctcgcgctacgcctcccatccctactcctcgcatcccaaggaggctctcgttgtcggggagaaattattcttggtagatttgaggtttgcagcggagttggggagcgaaaggggaggggaagctgcgaagtggggtgttgatgagaacgagaaccctgaaatgggccgttattggcctcctttggtggaagtagcagaaactaggcagttacctcctatgctggttgaaagatataatgccgctgctggtgaaggaacagctctttgtggaatattttctgaagtacaccgtgcctgggcaactgttgacaattcattttttatttggcgctttgataagtgggatgggcaatgtcaagagcataacgcggatgaacaagtgatttgtgctgttggccttgctagagcaaagcctggtgtttttgttgcagccattcagtaccttttagtattagcaactcctgttgagctgatacttgtcggagtttgctgttcagctagtggtgatggaactgatccgtatgcggagctctcattgcaacctttacctgagtacattatttctactgatggtgtcacaatgacatgcatcacttgtacagataagggtcaaattttcctatctgggcgtgatggccatatatatgagctgcaatatacaactggttcaggttggcgaaagcgctgccgtaaatctcccaattattcaaacatgcttttcaggtgggttttgccaaatgcattcaagttctcggctgttgatcctattgttgatatggttattgatgaggagagaaatacaatttatgcgcgcacagaaggcatgaagatgcagctatttgatttaggagctactggcgatggtcctctgagaaagatcactgaagaaaagaatcttgttgatccacgagatgcaccttatggcagtcggaggcctaatgcacaaagagctgcacgatccccaaaaccatcaattgtctgcattgcacctttgtcagctatggaatcaaaatggcttcatgctgttgctgttttatcagatggcaagagactgttcctttctacatcaggtgggagtagttcagttggacttagcactggtttgcagaggccaagctgtctaaaaattgttgctaccaggccttccccacctctaggggttggtggtggtctcacatttggtgctgtttcagctgctggcagagctcaacctgaggatcttgctttaaaagtggagtccgctttctattctgccggtgctcttataatgtcagattcatctgctacagctatgtcctcccttctcgctgtgcagaaagattcagctgcccaattatcccttcccagtacttttgggacagcatctagaagctcgagggctctgcgagaaacagtctctgctttgcctgttgaaggtcggatgctttgtgcctctgatgtcttcccgcttccagatgctgctttcatcatgcagtcattatatgcagacgtggaatgctttgcatcttttggaaaaccttctgagaagtcatccattaaactgtgggctaaaggagatcttcctacccagcatatcttacctcggaggaggattgttatattcaatactatgggtttgatggaggtagtttttaacagacctgttgatatcctaagaaaattgtttgatgggaacactttgagatctcagttagaagaattctttagccgctttggtgctggagaggctgcagcaatgtgcttaatgctagctgctaagctgctttatgctgaagatagcctgataagcaatgcagtttctgagaaagctgctgaagcatttgaggaccctggacttgtcggaatgcctcaaattgatggcagtactgccttgtctaacactcgaactcaggctggaggctttagtatgggacaagttgttcaagaagcacaacctatattttctggtgcatatgaagggctttgcttgtgctcttctagactactgtatcctatctgggaacttccaattatggtggttcgaggactggtaggttccaatgatcgtggtgatggtgtggttgtttgcaggctttctactggggccatgaaggttcttgagagtaagatccgttcattggaaacatttttgaggtcaagaagaaacaaaagaagaggactttatggttatgttgctggtctaggagattctggttccatactgtacaaagcagggcctatcattgggtctggtggtcatagcagtgggaagagtccatacagctctcgcattagagacgctgatccaacagatcagtctgcatcaaataaaaagcaaaggctgccttacacatcagccgaactagctgcgatggaggtgagggcaattgagtgccttaggcggttgcttcgaagatctggtgaagcactctttctgcttcaacttatttgccagcataatgttgctcgcttggttcagacactaggtaatgatttgcgcaagaaactagttcagttaacatttcatcagttggtatgttctgaggatggtgaccagcttgccatgcgccttatttctgcactcatggagtactatatcggtccagagggcaggggaactgttgatgagatcagcactaaattgagagagggttgtcctagttacttcaatgagtcagattataaatattacttagcagtggaatgccttgagagagcatctatgacaaacaatcatgacgagaaagacatccttgctagagatgccttcaatcttttaactaaaattcctgactctgctgacttgagtgctatatgcaagagatttgagaacctaaggttctacgaggcagtagtccgtttgcctttacagaaagctcaagcacttgattccaatgctgatgttattaatgggcaaatcgacgcaaggcatcatgatactataactgcacagcgtgaacagtgctataaaatagttatgaatgctttacgtaccctcaagggtgttggacagagtggcacacaaggtgcagacaagtcatctgcttcagttactgcacttgatccagcttctcgagggaagtatattaaacagattattcaattaagtgtccagtggccagacacagtgtttcatgagcatctgtataggactcttattgagcttggtttggaaaatgaacttttggaatatggaggttctgatctggttgcttttctccagagcgctggtcgtaagcatcatgaagaggttcaaggactttctgtggttgcatcaaaagcctctaaactgactgatttggatgcacctatttcaactagtcaaaccaagtatcttgagctgctagccaggtattatgttctcaagggggagcatattgctgctgctagaatgttgttgatattggcagaaagacagtgctccagtgcggaagaagctccaactcttgaccagaggtatcaatatctgagcagtgcagcgattcaggccaaaagtgcaggcattactgcagattcttcgaggaatcctattgatagcagcacgatagatctacttgaaggcaaacttgcagttcttcggttccaaatgcaaatcaagcaagaactagagttcatggcttcacagcttgaaaatctgtcaggcagttctgaatcaccaaatgatccctttcctcgtgataacattctagctgatgcggatactgctagatttgccatggacaaggctaaagagctttcactgaatctaaagagtattactcaactttacaacgattatgctgttccatttaatctttgggaggtttgcctggaaatgctcaactttgcaaattattctggagatgctgacagtaaaattgttcgagaaatttgggccaggcttcttgaccaggcacttacaagaggtggtgttgcagaagcatgttctgtggtgagaagagtaggttcaaaacttgatcctgcagatggcgcttgtttaccattggatataatatgccttcatctcgagaaggctgcattggatagattaagctcaggagaagaattagttggtgacgaggatgttgcaagagcccttctcggagcctgtaaaggtctacctgaacctgtgcttgccgtgtatgatcaactgttatcaaatggcgctattgttccctccctaaacctgaagctgcggcttctgagatcagttcttgcaatccttcgtgaatggggcatgactgtcattgcacataaactaggcaccacaactgctggggcttcattctttcttgatggaacattttcgctgaatcaaacatggtctttaaatcaaggcgttcgagataaaataagtagtttggcaaaccggtatatggctgaggtgaggcggttaagccttccaaagaaccaaacagagaatgtctatcgagcaagtcctgcgggcgatgccattcgtctggcactacttgaagtggatcaggagagtggaaagggcccgaacctgtataaagatccttgtctccgtctcttttacatcaatctcgcatatatcccgacaccaacgatccccatactctacaaataccgtagtcgtgatctactccgtcgacagtggcgctccagggtgatacaactcgatgaggaccctcgccatctcaagctttgtcaagtcatcgccgctatggatttttcaatgagggatacttcaatgactttcgccctgggagatctgacccagccagagtacgctcctcgactagatcagaatcatcgtcgccaacaatttgatctattgagatcatccaaggttcaagacaattggcgtaccagaagatttcaaatatatatgatgttgaacaagtacgcaacaaggtatgactacacatctggtttgagtacatacgttgtagcgatcccaccatctctcagagttctctacgagtggttgaggtacgactgcacacctggtctgagtacaggtgttgtagcgatcccatcatctctccgagttctctatgagttggtacgactacaaacttggtttgagtacaggtacgactacacatctggtctgagtacaggcgttgtagcgatcccaccatctcttcgagttctctacgagtggagtggtcgaggtacgactacatacctcatacctggtcctcgaccaacagttgtagcgattctcccaccacatctacgagtggttgagtatgtcaacataccttgtcctcgaccatcggttgtagcgattctcccaccacatttacgagtggttgagtatgtttacatacctggtccctga

SEQ ID NO: 368 - protein, 1794 aa, Oryza sativa
MAWAEDEAIGPDVASAGLHVSERIGRDAAAQPDLEEALEASRYASHPYSSHPKEALVVGEKLFLVDLRFAAELGSERGGEAAKWGVDENENPEMGRYWPPLVEVAETRQLPPMLVERYNAAAGEGTALCGIFSEVHRAWATVDNSFFIWRFDKWDGQCQEHNADEQVICAVGLARAKPGVFVAAIQYLLVLATPVELILVGVCCSASGDGTDPYAELSLQPLPEYIISTDGVTMTCITCTDKGQIFLSGRDGHIYELQYTTGSGWRKRCRKSPNYSNMLFRWVLPNAFKFSAVDPIVDMVIDEERNTIYARTEGMKMQLFDLGATGDGPLRKITEEKNLVDPRDAPYGSRRPNAQRAARSPKPSIVCIAPLSAMESKWLHAVAVLSDGKRLFLSTSGGSSSVGLSTGLQRPSCLKIVATRPSPPLGVGGGLTFGAVSAAGRAQPEDLALKVESAFYSAGALIMSDSSATAMSSLLAVQKDSAAQLSLPSTFGTASRSSRALRETVSALPVEGRMLCASDVFPLPDAAFIMQSLYADVECFASFGKPSEKSSIKLWAKGDLPTQHILPRRRIVIFNTMGLMEVVFNRPVDILRKLFDGNTLRSQLEEFFSRFGAGEAAAMCLMLAAKLLYAEDSLISNAVSEKAAEAFEDPGLVGMPQIDGSTALSNTRTQAGGFSMGQVVQEAQPIFSGAYEGLCLCSSRLLYPIWELPIMVVRGLVGSNDRGDGVVVCRLSTGAMKVLESKIRSLETFLRSRRNKRRGLYGYVAGLGDSGSILYKAGPIIGSGGHSSGKSPYSSRIRDADPTDQSASNKKQRLPYTSAELAAMEVRAIECLRRLLRRSGEALFLLQLICQHNVARLVQTLGNDLRKKLVQLTFHQLVCSEDGDQLAMRLISALMEYYIGPEGRGTVDEISTKLREGCPSYFNESDYKYYLAVECLERASMTNNHDEKDILARDAFNLLTKIPDSADLSAICKRFENLRFYEAVVRLPLQKAQALDSNADVINGQIDARHHDTITAQREQCYKIVMNALRTLKGVGQSGTQGADKSSASVTALDPASRGKYIKQIIQLSVQWPDTVFHEHLYRTLIELGLENELLEYGGSDLVAFLQSAGRKHHEEVQGLSVVASKASKLTDLDAPISTSQTKYLELLARYYVLKGEHIAAARMLLILAERQCSSAEEAPTLDQRYQYLSSAAIQAKSAGITADSSRNPIDSSTIDLLEGKLAVLRFQMQIKQELEFMASQLENLSGSSESPNDPFPRDNILADADTARFAMDKAKELSLNLKSITQLYNDYAVPFNLWEVCLEMLNFANYSGDADSKIVREIWARLLDQALTRGGVAEACSVVRRVGSKLDPADGACLPLDIICLHLEKAALDRLSSGEELVGDEDVARALLGACKGLPEPVLAVYDQLLSNGAIVPSLNLKLRLLRSVLAILREWGMTVIAHKLGTTTAGASFFLDGTFSLNQTWSLNQGVRDKISSLANRYMAEVRRLSLPKNQTENVYRASPAGDAIRLALLEVDQESGKGPNLYKDPCLRLFYINLAYIPTPTIPILYKYRSRDLLRRQWRSRVIQLDEDPRHLKLCQVIAAMDFSMRDTSMTFALGDLTQPEYAPRLDQNHRRQQFDLLRSSKVQDNWRTRRFQIYMMLNKYATRYDYTSGLSTYVVAIPPSLRVLYEWLRYDCTPGLSTGVVAIPSSLRVLYELVRLQTWFEYRYDYTSGLSTGVVAIPPSLRVLYEWSGRGTTTYLIPGPRPTVVAILPPHLRVVEYVNIPCPRPSVVAILPPHLRVVEYVYIPGP

SEQ ID NO: 369 - DNA, 135 bp, Oryza sativa
atggccgggtcggtggaagcctcggcctgcgatgtgaaggctaacgatgacatggtggccgagaaggcggtgatgaagctcgccacccgccgttttcttcttcccaagactcaccagctgtcgatgctgatctag

SEQ ID NO: 370 - protein, 44 aa, Oryza sativa
MAGSVEASACDVKANDDMVAEKAVMKLATRRFLLPKTHQLSMLI

SEQ ID NO: 371 - DNA, 864 bp, Oryza sativa
atggccgatcgcctcgagctccagggcaggcacggcaagtcccgcgtccgggtttcccgcgtttggcgccgccccgcggccgcgggaggccacgtcatcgtcgagtggaacgtggccgtcagcgtcgtctccgactgcctcccctcctacacctccgacgacaactccgccatcgtcgccaccgattccatcaagaacaccggtgtatgtgaaggccaaggaatgcacggagattgtctccatggaggaattcgcggtgattcttggaaggcatttcacctcgctgtacccgcagatcgccgagcgtccatgggagcgtgtggttgtcgatgggaagcctcattcccacggggttcaaacttggtgttgagaagcacgtcacagaggtcattgtgaagaagtctggaaacttgctcataaattctggaatccaaggatactccctgctaaagacaactcagcagtccgggttcgaaaaatttgtgagggatcgctacacacttcttcctgatacaagagaaaggattgtagcaacagaagtaactgcctggtggagttcacacaaaggtatcaggacgtaaagaaagttcttgcagatacgttctttggtcctcctgatgttggagtgtatagtccatcagtgcagaatacactatacctgatggctaaggaagttctcaacagaggttcccggatatagcatctgttcagctaaggatgccgaacctccactttatccctgttaacttagggaacaaagaaaatccaggattagtgaagtttgctgatgatgtgtacctgccgaccgatgaaccacacgggaccattgaagcaacagtgagccgccccaagtcaaagttgtaa

SEQ ID NO: 372 - protein, 309 aa, Oryza sativa
  misc_feature (99)..(105): Xaa = any naturally occuring amino acid
  misc_feature (192)..(207): Xaa = any naturally occuring amino acid
  misc_feature (249)..(249): Xaa = any naturally occuring amino acid
MADRLELQGRHGKSRVRVSRVWRRPAAAGGHVIVEWNVAVSVVSDCLPSYTSDDNSAIVATDSIKNTVYVKAKECTEIVSMEEFAVILGRHFTSLYPQXXXXXXXIAERPWERVVVDGKPHSHGFKLGVEKHVTEVIVKKSGNLLINSGIQGYSLLKTTQQSGFEKFVRDRYTLLPDTRERIVATEVTAWWXXXXXXXXXXXXXXXXFTQRYQDVKKVLADTFFGPPDVGVYSPSVQNTLYLMAKEVLXQRFPDIASVQLRMPNLHFIPVNLGNKENPGLVKFADDVYLPTDEPHGTIEATVSRPKSKL

SEQ ID NO: 373 - DNA, 1395 bp, Oryza sativa
atggaggtggagttgccatggggcgcgcggtgcgcggcggcggcgttcttcgtgtcctcgctgtgcgtggcggcgctcggcgtcgtgctcctgctcctcaggcggtggccgtggtgcggctgccatgtctgccgcgcctacctggccgggtcgtggaggagggagttcgccaacctcggcgactggtacgccgacctgctccgccgctcgccgacgggcaccgtccacgtccacgtcctcggctgcaccgtcacggcgaacccggcgaacgtggagtacatgctcaagacgcgcttcgacaacttccccaaggggaggccgttcgccgcgctcctcggcgacctcctcggcgacggcatcttcaacgtcgacggcgacgcgtggcgccaccagcggaagatggccagcctcgagctggggagcgtcgccgtgagatcctacgcgtacaagatcgtcgcccaggaggtggaggcccgcctcatgccggtgctcgccaacgccgccgacagcggcgccgtggtcgacctgcaggacgtgttccgccgcttcgccttcgacaccatctgcaagatctccttcggcctcgacccgggctgcctcgaccgggagatgcccgtgtcggagctcgccgacgcgttcgacgccgcgtcgcggctgtccgccatgcgtggcgcggcggcgtcgccgttgctgtggaagatgaagcggtttctcaacgtcgggtcggagagggagctcaagaaggccatcaagctcatcgacgggctcgcggcggcgatgatccgggagcgccggaagcttggcgtcgcgaacagccacgacctcctgtcccggttcatggccatcgtcgtaagcttcctcctcgccggccgggacacggtgtcctccgcgctcaccactctgttcatgatcctgtccaagaaccccgacgtggcggccgccatgcgcgcggaggccggcgccgccgccggcgagagcgccgccgtcagctacgagcacctgaagcggctgaactacacccacgccgtgctgtacgagaacatgcggctgttcccgccggtgcagttcgactccaagttctgcgccgccgccgacgtgctccccgacggcacctacgtcgacggcggcgcgcgcgtcatgtaccacccctacgccatgggccgcatgccgcgcatctggggcgccgactgcgacgcgttccggccggagccgtggctaaccggcgccggcggcgcgttcgtgccggagagcctcttcaagtacccggtgttccaggccggcctccgcgtgtgcctcggcaaggagctcgccatcaccgagatgaaggcgagattcgtgccggggctcaccgcgtccatcagcggtgggctcccagtgaagatcagacgcgtttag

SEQ ID NO: 374 - protein, 464 aa, Oryza sativa
MEVELPWGARCAAAAFFVSSLCVAALGVVLLLLRRWPWCGCHVCRAYLAGSWRREFANLGDWYADLLRRSPTGTVHVHVLGCTVTANPANVEYMLKTRFDNFPKGRPFAALLGDLLGDGIFNVDGDAWRHQRKMASLELGSVAVRSYAYKIVAQEVEARLMPVLANAADSGAVVDLQDVFRRFAFDTICKISFGLDPGCLDREMPVSELADAFDAASRLSAMRGAAASPLLWKMKRFLNVGSERELKKAIKLIDGLAAAMIRERRKLGVANSHDLLSRFMAIVVSFLLAGRDTVSSALTTLFMILSKNPDVAAAMRAEAGAAAGESAAVSYEHLKRLNYTHAVLYENMRLFPPVQFDSKFCAAADVLPDGTYVDGGARVMYHPYAMGRMPRIWGADCDAFRPEPWLTGAGGAFVPESLFKYPVFQAGLRVCLGKELAITEMKARFVPGLTASISGGLPVKIRRV

SEQ ID NO: 375 - DNA, 409 bp, Oryza sativa
atggtgagagtcagtgtcctcaatgacgctctgaaaaccatgtacaatgctgagaagcgtggtaagcgccaagttcttatccggccctcgtcaaaggtgatcatcaagttcctcatcgtcatgcagaagcatggttacatttctgactgcaggttacattggtgagtttgagtttgttgatgaccaccggtctggcaagatcgtggttgagctgaatggacgccttaacaagtgtggtgtcatcagcccacgctttgatgttggtgtcaaggaaatcgagtcctggactgctaggctgcttccctcccgtcaggggtacattgtccttaccacctctgccggaatcatggaccacgaagaagcgaggcggaagaacgtcggaggcaaggtgctcggctttttctactag

SEQ ID NO: 376 - protein, 136 aa, Oryza sativa
  misc_feature (105)..(105): Xaa = any naturally occuring amino acid
MVRVSVLNDALKTMYNAEKRGKRQVLIRPSSKVIIKFLIVMQKHGYISDCGYIGEFEFVDDHRSGKIVVELNGRLNKCGVISPRFDVGVKEIESWTARLLPSRQXGYIVLTTSAGIMDHEEARRKNVGGKVLGFFY

SEQ ID NO: 377 - DNA, 1875 bp, Oryza sativa
atggaagacgccagcaggggagaagaagaaaattcgatgttcgagaccagccacgtcctcggcgcgctgctcgcctcctcgccgctgctggcgcgggcgtgggaccggcggcgctgtcggcggcggcgggcggcggccggggcgccgagatcttcaagccggtcgggctccgcggggacgccgccgggcggctgttcgcgccgctggtcgccgccgagccggaggacgccggcgaggaagccggtcgccgtgcaggcgctggcgctgcaggggttcttgaggctgtgcagatcccctgaattccaggtgctgctgaaccagatcagaggcaaggcagtagtgttcactggccactccctcggtggtgccattgctgcccttgtggcgctgcactacctttgcacatcatcgtcaagctcagcatttgcccctgctcctccggtgctttgtgtcacattcgggagcccgctgcttggcaatcaggccctgtctagggctatcctgcgtgagcggtgggccggcaacttctgccatgtggtctcacagcatgatgttgtcccaaggctcctcttctgcccactcaatgtcatccctgtgcacattgttgttggtatgcagctgcaccagttgccggtgcgcgcgcgccgtgcagccggtgtggtggccacggtcactgcccgcatggctgacaccaaccaggagtcgctgcggcagctgatccaagagcacgccggtgaggcagcaattgagcagaagcttgctgctccggaaatacccagtgggagcccataccggccttttggggcgtatgtcctgtgctctccggatggtgcggcgtgtgtcgacaatccaacagcagcggttcagatgctatatgcaacatttgctgcaaggcgtgctccagagacaggcgcggtgccacctgaggctgcacactcctgctacggtgacctcgtgctgagcatgccgcaccacttgctgctcaagaggcgccttggtgccacagtcaccgcacctgccgcgtccaactacgacgtcggcatctccattgcactggaggcatcaggtatcaccggtgaagctacagaggcagcaccggcacggcagtggctgaagacgtcgaagcgcgtgggccggagcccgagcctgaactgtgcgagcctcgcaacgcggttgggacggatcacgccgtgccgagcgcagatcgagtggtacaaggcattgttcgatgccaacaccgggtattacgacgcattcaagcagcggctatcacctaagaagttcagcaaggccaacatgtaccgcatcaagctcgcacagttctgggatggcgtcctctccatgcttgacaccagccagctcccctacgacttccaccgccgtgccaagtgggtcaacgctgcccacttctaccagctccttgttgagccacttgacattgccgactaccaccgaaacaacctacaccgcacacgcggctcttacatcacccatggccgggagagaaggtatgagctgttcgacaagtggtggaaacagaagggctgcacagatcccagcactggtgacacctctgccaccacgacagcgaggaggagcaagttcgctgggctaacgcaggacccgtgcttctgggcgagggtggaggaagcgcgcgagcagacagagagtgccaagagcgaacgcgacatgacatcgctggcgaggatgctggaggacttgcacaagtttgagcgccattccagcgagctggtggagaacaaggaggtctccattgatgtcgttgcgccacagtcgagctactccctgtgggtgaaggagtggaatgagctcaagctccgggaagaagttaggacaatattgtttcaattttga

SEQ ID NO: 378 - protein, 624 aa, Oryza sativa
MEDASRGEEENSMFETSHVLGALLASSPLLARAWDRRRCRRRRAAAGAPRSSSRSGSAGTPPGGCSRRWSPPSRRTPARKPVAVQALALQGFLRLCRSPEFQVLLNQIRGKAVVFTGHSLGGAIAALVALHYLCTSSSSSAFAPAPPVLCVTFGSPLLGNQALSRAILRERWAGNFCHVVSQHDVVPRLLFCPLNVIPVHIVVGMQLHQLPVRARRAAGVVATVTARMADTNQESLRQLIQEHAGEAAIEQKLAAPEIPSGSPYRPFGAYVLCSPDGAACVDNPTAAVQMLYATFAARRAPETGAVPPEAAHSCYGDLVLSMPHHLLLKRRLGATVTAPAASNYDVGISIALEASGITGEATEAAPARQWLKTSKRVGRSPSLNCASLATRLGRITPCRAQIEWYKALFDANTGYYDAFKQRLSPKKFSKANMYRIKLAQFWDGVLSMLDTSQLPYDFHRRAKWVNAAHFYQLLVEPLDIADYHRNNLHRTRGSYITHGRERRYELFDKWWKQKGCTDPSTGDTSATTTARRSKFAGLTQDPCFWARVEEAREQTESAKSERDMTSLARMLEDLHKFERHSSELVENKEVSIDVVAPQSSYSLWVKEWNELKLREEVRTILFQF

SEQ ID NO: 379 - DNA, 328 bp, Oryza sativa
atggcgaggcggctgatcccgtcgctgaaccgcgtgctggtggagaagctggtgcagcccaagaagagcgccggcggcatcctcctccctgagacgtccaagcagcagctcaactctggtaaagtggtggctgttggccctggcgaacgtgacaaggatggcaagctgatccctgttgctctcaaggaaggagacactgttctcctgcctgaatatggtggactcgaagtcaagcttgctgctgaaaaagagtaccttctcttcagagagcatgacatcttgggcacccttgtggactgatttggatcgtcatgaacgccatcagtaa

SEQ ID NO: 380 - protein, 99 aa, Oryza sativa
MARRLIPSLNRVLVEKLVQPKKSAGGILLPETSKQQLNSGKVVAVGPGERDKDGKLIPVALKEGDTVLLPEYGGLEVKLAAEKEYLLFREHDILGTLVD

SEQ ID NO: 381 - DNA, 1365 bp, Oryza sativa
  misc_feature (726)..(726): r = adenine or guanine
atggccatgggattgttagcgtggattgttgcaacggccgccggcggcggtcctggcgtcttgggcgttcagcgcggtggtgcacctggaaggacattcctgtattggttcggagcacagccaaacatatgcttggctgacgtgagcatggtgtggcaggtattgtcagaccggacggggatataccccaagaacctgacgaaccctcactttgtgcgtctacttggcaaggggcttgtgctcactgacggcgatgagtggaagcgccaccgcaaggtggtccacccggcctttaacatggacaagctcaagatgatgacgatgaccatgtctgactgctctcggtccatgatgtcggagtgggaatcggagttggcggcgaagggtggtcttgttgagattgagctaagcaggcggttcgaggagctcactgccgatgtgatctcgcacacggcgtttggtagcagctacaaggaggggaagcaggtcttcctggcacagagggagctccaatttcttgccttctccaccttcctcactgttcaaattccagggtttagctaccttccgaccatgaaaaacttcaagacatggtcgctcgacaagaaggtgaggggcatgctcatggacatcatcaagacccggcatgccaacaaggatgtagctgggtatgggaatgacctacttgggttgatgctggaggcatgtgcgccggagcacggggaragctgcccacaactgagcatggatgagatcattgacgagtgcaagaccttcttttttgcagggcatgacaccacatcacacttgctcacctggaccatgttcctgctgagcacgcacccagattggcaggagaaattaagggaggagattgcaatggagtgtggtgacaaggtgcccactggtgacatgctcaacaagctaaagatggtcaacatgttcctcctagagaccctaaggctgtacagccctgtctcactcatacggaggaaggttgacactgatattgagctcggcggcatcaagatgcctgagggtgcactattgacgatcccgatcgcgacaattcaccgtgacaaggaagtgtggggggaggatgcggatgagtttaggccggagaggttcgagaatggggtgacgagggcagcgaagcaccccaacgcactactctccttctccagcggaccgaggtcatgcattgggcagaactttgcaatgatcgaggccaaggctgtcattgccatgatcctacagaggttctccttcactttgtcccccaagtacgtccatgcacccactgatgtgatcacgctgcgtcccaagtacgggctccctatgatcctcaagagcctcaagctgtag

SEQ ID NO: 382 - protein, 454 aa, Oryza sativa
MAMGLLAWIVATAAGGGPGVLGVQRGGAPGRTFLYWFGAQPNICLADVSMVWQVLSDRTGIYPKNLTNPHFVRLLGKGLVLTDGDEWKRHRKVVHPAFNMDKLKMMTMTMSDCSRSMMSEWESELAAKGGLVEIELSRRFEELTADVISHTAFGSSYKEGKQVFLAQRELQFLAFSTFLTVQIPGFSYLPTMKNFKTWSLDKKVRGMLMDIIKTRHANKDVAGYGNDLLGLMLEACAPEHGDSCPQLSMDEIIDECKTFFFAGHDTTSHLLTWTMFLLSTHPDWQEKLREEIAMECGDKVPTGDMLNKLKMVNMFLLETLRLYSPVSLIRRKVDTDIELGGIKMPEGALLTIPIATIHRDKEVWGEDADEFRPERFENGVTRAAKHPNALLSFSSGPRSCIGQNFAMIEAKAVIAMILQRFSFTLSPKYVHAPTDVITLRPKYGLPMILKSLKL

SEQ ID NO: 383 - DNA, 1263 bp, Oryza sativa
  misc_feature (581)..(581): r = adenine or guanine
atgtcgaagcagatggcacaggtgagccgcctccggttgacccgcgtgggcacggtgctgttgcctacattcttcaccccgcaccgagtgcgtgcagctcgcggacgaatgagtacgactcggcgatgcgccgatgccgaggaggtagtcgccgtacgccaccgccgtggagtactccgccgcttgggcgtgcgccatggcgtagtagttctcgaggaagtcgttggtgcccatgctgacgacgtagagcgcctccgacaacgtcgccgccgccgcgtcttcgtcctcccggaagctttgaagcctcgccgcgtactccttgaagtagtccagctccttccacatcggcagcaccgactgcacgacgcgacctcacaaaattactccatggatgccatgtgtgatgtcacccaagaacaccatgaaaatgctaacgaaaagatcagaggtggcattgtcgtagccggcgccggcggaggcgaagcatgcgccggcggcaaggctgctcatgttgacgcccgggtcaagggccgggacgagcggcggcagcccgaacgcctcggagtgaagtcgacggcaargaaaatggtgaaagatgatggtcaagttgcacctgaatttgctgatgcagatgaagaaaagctatatgagtttcttaatatccaaatggagagtgatttaaatctgaaaagaatgcggcattatgaagtggtttacctaattcatgaggatcgtgtggaagaagttgaagatgttgtatcaaaagtacaagattttgtcagagagaagaaaggaaggatatggaggcttaacaattggggactgcgtagacttgcttacaaaataaagaaagcaagacatgccaactacatcttaatgaactttgagatacaggcaaaatacatcaatgacttcaagaccctgctagataaggacgagagaatcattaggcatctcgtgatgaaacgggacgaggcgatcactgaagactgctctcccccaccagagttccacaccctgcgagctcaacaacagtatatggatgatgaatacattgatgatgaagatgatggcaaagaggagcaggagccggaggaggattgggatgacaagggtgaaatggagaacgctggttatgaagatgatgatgaacctgaaattattcttgttgatgaagtcgagcgcgataacaacgaaaacattagaagaaggaacaggacaatgaaagtagagaagtacgcagctgagaaagtcttgaggtag

SEQ ID NO: 384 - protein, 419 aa, Oryza sativa
MSKQMAQVSRLRLTRVGTVLLPTFFTPHRVRAARGRMSTTRRCADAEEVVAVRHRRGVLRRLGVRHGVVVLEEVVGAHADDVERLRQRRRRRVFVLPEALKPRRVLLEVVQLLPHRQHRLHDATSQNYSMDAMCDVTQEHHENANEKIRGGIVVAGAGGGEACAGGKAAHVDARVKGRDERRQPERLGVKSTAKMVKDDGQVAPEFADADEEKLYEFLNIQMESDLNLKRMRHYEVVYLIHEDRVEEVEDVVSKVQDFVREKKGRIWRLNNWGLRRLAYKIKKARHANYILMNFEIQAKYINDFKTLLDKDERIIRHLVMKRDEAITEDCSPPPEFHTLRAQQQYMDDEYIDDEDDGKEEQEPEEDWDDKGEMENAGYEDDDEPEIILVDEVERDNNENIRRRNRTMKVEKYAAEKVLR

SEQ ID NO: 385 - DNA, 887 bp, Oryza sativa
atggacgccttctactcgacctcgtcggcgtacggagcggcggcgagcggctggggctacgactcgctgaagaacttccgccagatctcccccgccgtccagtcccacctcaagctcgtttacctgacactatgcgtcgccctggctgcgtcggcggtgggcgcatacctgcacgtcgccttgaacatcggcgggatgttgactatgctcgggtgcgtggggagcatcgcctggttgttctcggtgcctgtctttgaggagtgagcagaggaagaggtttgggattctcttggccgctgccctgctggaaggggcttcagttgggcctctgatcaagcttgctgtagactttgactcaagagcattctcgtaacagcatttgttggaactgccattgcatttgggtgcttcacttgcgctgccatcgttgccaagcgtagggagtacctctaccttggtggtttgctctcttctggcctctccatcctgctctggctgcagtttgccgcatccatctttggccactccaccggcagcttcatgtttgagcaggtttactttggcctgttgatcttcctggggtacatggtgtatgacacgcaggagatcatcgagagggctcaccacggtgacatggactacatcaagcacgcactcaccctcttcactgacttcgtggccgtccttgtccggatcctcgtcatcatggctcaagaacgcgtctgacaagtcggaggagaagaagaggaagaagaggtcttgagagcttctcttcccgctttgcacataagaaaaaaccaccgcgggctattgcctctacgtattatgacagagccgcacttcaactgggttttatggtgaatacaagttcttttgcattttgttga

SEQ ID NO: 386 - protein, 253 aa, Oryza sativa
  misc_feature (88)..(88): Xaa = any naturally occuring amino acid
  misc_feature (120)..(120): Xaa = any naturally occuring amino acid
MDAFYSTSSAYGAAASGWGYDSLKNFRQISPAVQSHLKLVYLTLCVALAASAVGAYLHVALNIGGMLTMLGCVGSIAWLFSVPVFEEXARKRFGILLAAALLEGASVGPLIKLAVDFDSXSILVTAFVGTAIAFGCFTCAAIVAKRREYLYLGGLLSSGLSILLWLQFAASIFGHSTGSFMFEQVYFGLLIFLGYMVYDTQEIIERAHHGDMDYIKHALTLFTDFVAVLVRILVIMLKNASDKSEEKKRKKRS

SEQ ID NO: 387 - DNA, 673 bp, Oryza sativa
atggtgaacacggcggcggtggcggcggcgaagggcagcaggggcagcgggctgccgctggcgtcgctgaaccacatcagcatcgtgtgcaggtcgttgcaggagtcgctcaccttctacaccgacgtgctcggcttcttccccgtccgtcgccccggatccttcgacttcgacggcgcatggtacacacaattcacatccaatgtttttcccttcgatctggaggctgtttaattatgggattggtatccatctgcttcaggctgaagatcctgacagcctgccagggaaaacagagatcaatcctaaagataatcacatctccttccagcagtgtgagagcatggtggcagtggagcggcggctgaaggagctaggcatcccttacatacaacgatgtgtggaggaaggtggcatctatgtggaccaaatcttcttccacgatcccgatggcttcatgatcgagatctgcaactgcgacaacctccccgtcgtccccctcggcgccgaccagccgctcgtcatggccgcctgcaagagggccgccgtcatcaagcagcagcagcaggcgtcctcttctccggcgacggcggcggcggcggcacagtgcgccgtgccatcgtcgacgaaggcgatccacgtcggcgaggaggcacacatctcgtgcgcctaa

SEQ ID NO: 388 - protein, 223 aa, Oryza sativa
MVNTAAVAAAKGSRGSGLPLASLNHISIVCRSLQESLTFYTDVLGFFPVRRPGSFDFDGAWYTQFTSNVFPFDLELFNYGIGIHLLQAEDPDSLPGKTEINPKDNHISFQQCESMVAVERRLKELGIPYIQRCVEEGGIYVDQIFFHDPDGFMIEICNCDNLPVVPLGADQPLVMAACKRAAVIKQQQQASSSPATAAAAAQCAVPSSTKAIHVGEEAHISCA

SEQ ID NO: 389 - DNA, 1004 bp, Oryza sativa
atggcgccggacgtcgaggcgcggctgctcgccgcctcctccaagccggccaccgccgccgccgcctcgctgccgcgccgcaacaagtaccccttcttctgcgccgtcctcgcctccatgacgtgacgagcggggcgcagatcttcatggcggaggacctgggcgtgagcgacgcgcagatcgaggtgctttcgggggccatcaacatctactcgctcgtcggcgcgctgctcgccgggtggacctccgaccgcctggggcggcggctcaccatcgtgctcaccaacggcttcttcctcgccggcccgctcgtcatgtcgctcgccggcgggtacgccgcgctcatggccgggaggttcgtcgccggcatcggcgtcggctatgccctcgtcatcgcccccgtctacgccgccgagatctcccccgcctcctcccgcggcctcctctcctccctccccgagtttatcaatgggggagtgatgctgagctacgtgtcgaacttcgccttctcggggttgccggtgcacctgtcgtggcggctgatgttcgccgccggcgtggtgccgacggtgttcctggcggcgggcgtgctcaccatgccggagtcgccgcggtggctggcgatgaaggggcggcgcggcgaggcgagggtggtgctcgaccgcacgtccgacacgccggccgaggccgagcagcggctggtggtggcgttcgtgtgcgcgttctccgtcgggatcgggccgctggcgtgggtgtacagctcggagatcctgccgctgcggctgcgcgggcagggcgccggcgtcggcaccgccatgaaccgcgtcgtcagcggcgtggtcaccatgacgttcatctcgctctacggcgccatcaccatggcgggggcgttctacctctacgccgccatcgccgccgcctccttcgtgttcatctacgcctgcctgccggagaccagggggcggagcctcgaggacatggaggagctcttccacaccaagtga

SEQ ID NO: 390 - protein, 333 aa, Oryza sativa
  misc_feature (42)..(42): Xaa = any naturally occuring amino acid
MAPDVEARLLAASSKPATAAAASLPRRNKYPFFCAVLASMTXRAGRRSSAEDLGVSDAQIEVLSGAINIYSLVGALLAGWTSDRLGRRLTIVLTNGFFLAGPLVMSLAGGYAALMAGRFVAGIGVGYALVIAPVYAAEISPASSRGLLSSLPEFINGGVMLSYVSNFAFSGLPVHLSWRLMFAAGVVPTVFLAAGVLTMPESPRWLAMKGRRGEARVVLDRTSDTPAEAEQRLVVAFVCAFSVGIGPLAWVYSSEILPLRLRGQGAGVGTAMNRVVSGVVTMTFISLYGAITMAGAFYLYAAIAAASFVFIYACLPETRGRSLEDMEELFHTK

SEQ ID NO: 391 - DNA, 498 bp, Oryza sativa
atggagaacgtcaccggaggaggaggaggaggatcgccgcggcgggtggtggtggcggtggacgagagcgaggagagcatgcacgcgctgtcgtggtgcctctccaacgtggtctccgtcctggtccacgcccggccggcgcggccgctctactacccggtgatcgacggcggcggctacgtgctgacccaggaggtgatggacagcatggaccgctacatggccaccgccgccgactccgtcgtcgccaaggcccgcgacatctgcaccgccttccccaatgtgaaggtggagacgcgggtggagaaaggggacccgagggatgtgatctgcggggcggtggagaaggccggcgcggacatggtggtgatggggagccatggttacggtttcctgcagaggacgctgctggggagcgtcagcaaccactgcgtccagcactgcaagtgccccgtcgtcgtcgtcaagaggcccggcaccaacgccaaggcctcttga

SEQ ID NO: 392 - protein, 165 aa, Oryza sativa
MENVTGGGGGGSPRRVVVAVDESEESMHALSWCLSNVVSVLVHARPARPLYYPVIDGGGYVLTQEVMDSMDRYMATAADSVVAKARDICTAFPNVKVETRVEKGDPRDVICGAVEKAGADMVVMGSHGYGFLQRTLLGSVSNHCVQHCKCPVVVVKRPGTNAKAS

SEQ ID NO: 393 - DNA, 1091 bp, Oryza sativa
atggcgcggcgatccgcccccctcctccgccgcatcctctcctccccggcccccgccccggcgcaccatggcggcgccggcgcgcgccgcacggtgacctacatgcccaggccaggggacgggaacccgcgcgccgtgacgctgatcccgggggacgggatcgggccgctcgtgacgggggccgtgcagcaggtgatggaggtgatgcacgcgccggtctacttcgagacctacgaggtccgcggcgacatgcccaccgtgccgcccgccgtcatcgagtccatccgccgcaacaaggtgtgcctcaagggcggcctcgccacccccgtcggcggcggggtctcctccctcaacatgcagctccgcaaggagctcgacctctacgcctcgctcgtcaactgctccaacttccccggcctccccaccaggcaccaggacgtcgacatcgtcgtcatcagggagaacaccgagggggagtactcggggctcgagcacgaggtcgtgcccggcgtcgtcgagagcctcaaggtgataacaaagttttgctctgagaggattgccaaatatgcttttgagtatgcttaccttaacaaccgaaagaaagtcacagcagtgcataaagcaaacatcatgaagcttgctgatggtttgttcttggaatcttgccgtgaggttgcctcaaagtatcctggtattcagtataatgagatcattgtcgacaactgctgtatgcaacttgttgcaaagcctgagcaatttgatgtcatggttacaccaaacctttatggcaatttggttgctaacacggctgcagaggtaatgtgggtcaggaccatgctgtctttgagcaaggtgcttctgcaggaaacgtcggaaacgagaacatcttagagcagaagaaagcaaaccctattgcgctgcttctatcatccgccatgatgttgaggcatttgcagttcccgtcattcgccgaccggctggagacggcggtgaagcgtgtcattgcggaaggcaagtacagaacaaaggatctaggcggcaccagcaccacccaggaagtcactgatgcagtaatcgccaatctggattag

SEQ ID NO: 394 - protein, 362 aa, Oryza sativa
MARRSAPLLRRILSSPAPAPAHHGGAGARRTVTYMPRPGDGNPRAVTLIPGDGIGPLVTGAVQQVMEVMHAPVYFETYEVRGDMPTVPPAVIESIRRNKVCLKGGLATPVGGGVSSLNMQLRKELDLYASLVNCSNFPGLPTRHQDVDIVVIRENTEGEYSGLEHEVVPGVVESLKVITKFCSERIAKYAFEYAYLNNRKKVTAVHKANIMKLADGLFLESCREVASKYPGIQYNEIIVDNCCMQLVAKPEQFDVMVTPNLYGNLVANTAAEVMWQDHAVFEQGASAGNVGNENILEQKKANPIALLLSSAMMLRHLQFPSFADRLETAVKRVIAEGKYRTKDLGGTSTTQEVTDAVIANLD

SEQ ID NO: 395 - DNA, 465 bp, Oryza sativa
atggcggcggaggccgggagcggcggcgtggtgaagcacatcctgctggcgcggttcaaggaggacgtggcgccggagcggctggaccagctcatccgcggctatgccggcctcgtcgacctcgtcccttccatgaaggccttccactggttggtgttcttgtcttcccacccgcctgctttcgatctcctcgtctcgtacagatgcaccgtttatccccatttgttcggtgcctgtctggtgctcgacgaattaattgcctgcttcgagttcggaaggggaactgacgtgagcatagagaacatgcaccaaggattcacacacgtatttgagtccacttttgaaagcacagaaggagtcaaggagtacattgaacacccagcacatgttgaatttgcaaacgagttcctgcctgtgttggagaagaccctcataatcgactacaagccaactatcggtaaataa

SEQ ID NO: 396 - protein, 154 aa, Oryza sativa
MAAEAGSGGVVKHILLARFKEDVAPERLDQLIRGYAGLVDLVPSMKAFHWLVFLSSHPPAFDLLVSYRCTVYPHLFGACLVLDELIACFEFGRGTDVSIENMHQGFTHVFESTFESTEGVKEYIEHPAHVEFANEFLPVLEKTLIIDYKPTIGK

SEQ ID NO: 397 - DNA, 333 bp, Oryza sativa
  misc_feature (57)..(57): h = adenine, cytosine, or thymine
atgtggccggggccagatttgggagagggaggggaggggagccgcctcagcgcacchgttgcccgcgtccgtgccgccgtcgccgtctacaccgccactgtcgctccccctcctctcgctagatctaggagcggggagggaaagagggggagccgccgccgccgtcgccccgtccgcaccgccgccgcctcatccgcgccaatgccgtcgctccccctcctccagctagatgtaggagcggggaggagagagggggggcgccaccccgtccgcgctgacgtcgccatccacgccgccgcgttcgcgccgctgccgtcgctcctcctcctctag

SEQ ID NO: 398 - protein, 110 aa, Oryza sativa
MWPGPDLGEGGEGSRLSAPVARVRAAVAVYTATVAPPPLARSRSGEGKRGSRRRRRPVRTAAASSAPMPSLPLLQLDVGAGRREGGRHPVRADVAIHAAAFAPLPSLLLL

SEQ ID NO: 399 - DNA, 349 bp, Oryza sativa
atgaagggacggcaaggccagcgcgtgaggctgtacgtccgcggcaccatcctcggctacaagagaggtcgaagtcgaaccagtacgagaacacgtcgctgctgcagatcgagggggtgaacaccaaggaggaggttgggtggtacgccgggaagcgcatcgcctacgtctacaaggccaagacgaagagcaacgactccaccatccgctgcatctggggcaaggtcacccgcccgcacggcaactccggtgtcgtccgcgccaagttccggtccaacctcccgcccacctccatgggtccgcgtcttcatgtaccccagcagcatctaaaagcatccaaggtacttag

SEQ ID NO: 400 - protein, 116 aa, Oryza sativa
  misc_feature (21)..(21): Xaa = any naturally occuring amino acid
MKGRQGQRVRLYVRGTILGYXERSKSNQYENTSLLQIEGVNTKEEVGWYAGKRIAYVYKAKTKSNDSTIRCIWGKVTRPHGNSGVVRAKFRSNLPPTSMGVRVFMYPSSIKASKVL

SEQ ID NO: 401 - DNA, 368 bp, Oryza sativa
atgtttgtgcagacgaagcgcaccaagaaggcaggaatcgttggcaaatatggtaatgacattggtaccaggtatggtgccagtttgcgtaagcagatcaagaagatggaggtttcccagcactccaagtacttctgcgagttctgtggcaaggctgtgaagaggaaagcagttggaatctggggatgcaaggactgtggcaaggtcaaggctggtggtgcctacaccatgaacactgccagtgcggtcacggtcagaagcacaatccgtcgcctgagggagcagacagaagcctgatcaggatctgtttgagaaagtgttcttggagttctatcaagactggtgaagttgccattttgcatatttag

SEQ ID NO: 402 - protein, 99 aa, Oryza sativa
  misc_feature (52)..(52): Xaa = any naturally occuring amino acid
MFVQTKRTKKAGIVGKYGNDIGTRYGASLRKQIKKMEVSQHSKYFCEFCGKXAVKRKAVGIWGCKDCGKVKAGGAYTMNTASAVTVRSTIRRLREQTEA

SEQ ID NO: 403 - DNA, 1314 bp, Oryza sativa
atgctcgacatcaacctcttccgcacggagaagggcggcgacccggagctgatccgcaggtcgcagcgcaaccgctccgcctccgtcgagctcgtcgacgaggtcatcgccctcgacgaccagtggcgccagagcaattcgagctcgacaaaatccggcaggagctcaacaaaaccagcaaggaaatcggcaagctcaaaggctaaaaaggaggacgcgtcggctctgattcagagcacggaagagattaagaagaggttggctgccaaggagacggaggtgcaggaggccaagggcacgctcgatgccaagctcgtgacgattggaaacattgtgcatgaatccgtccctgtcagcgatgacgaggctaacaatttaattgtacggacatggggagagaggaggctggagggtaatttgaagaatcacgtggatctttggtgctgatgtagcaggtggaaggggttactatttaaaggatgaaggtgtcctactgaacttggcattgataaattttggactcgcttttctgagaaagcgaggcttcaagccaatgcaaactccttttttcatgagaaaggaaaccatgggaaaatgtgcccagttggcccaatttgacgaagagctttacaagaagtatctcatcgctacatccgagcaaccgctgtgtgcgtatcatctaggtgatcgaatttatcctgctgaattgccaattagagatatgctggatattccacctgcttccggaaagaagctggttcacatggaagggacacggctggtatcttcagagtccaccaattcgaaaagattgagcaattctgtgttacaagtccaaatgacaatgaatcctgggagatgcatgaagaaatgataaaaaattcagaagatttctacaaggagctaccgtaccaacttgtctccattgtgtctggtgctcttaatgatgctgcagctaagaagtatgatttagaagcatggttccctgcatcaaaaacctatagggaattagtgtcctgctcaaattgcacagattttcaagcaaggagacttggtataggttatggccagaaaaaggagcaatccaagcaattcgttcatatgttgaactcaacattgactgccactgagaggaccctttgctgtattttggagaacttccagaaggagaatggtgtcgaagttccaaaagcattgcagccttacatgggtggaatcgatttccttccctttcaagctggatagcaaacaagttgctcgactccaaatcaaataatccaaattcaaaggtccgtctctacctctaggctctag

SEQ ID NO: 404 - protein, 435 aa, Oryza sativa
  misc_feature (45)..(45): Xaa = any naturally occuring amino acid
  misc_feature (69)..(69): Xaa = any naturally occuring amino acid
  misc_feature (147)..(156): Xaa = any naturally occuring amino acid
  misc_feature (222)..(228): Xaa = any naturally occuring amino acid
  misc_feature (256)..(256): Xaa = any naturally occuring amino acid
  misc_feature (317)..(318): Xaa = any naturally occuring amino acid
  misc_feature (379)..(380): Xaa = any naturally occuring amino acid
MLDINLFRTEKGGDPELIRRSQRNRSASVELVDEVIALDDQWRQXQFELDKIRQELNKTSKEIGKLKGXKGDASALIQSTEEIKKRLAAKETEVQEAKGTLDAKLVTIGNIVHESVPVSDDEANNLIVRTWGERRLEGNLKNHVDLXXXXXXXXXXGADVAGGRGYYLKDEGVLLNLALINFGLAFLRKRGFKPMQTPFFMRKETMGKCAQLAQFDEELYKXXXXXXXKYLIATSEQPLCAYHLGDRIYPAELPIXRYAGYSTCFRKEAGSHGRDTAGIFRVHQFEKIEQFCVTSPNDNESWEMHEEMIKNSEDFYXXKELPYQLVSIVSGALNDAAAKKYDLEAWFPASKTYRELVSCSNCTDFQARRLGIGYGQKKXXEQSKQFVHMLNSTLTATERTLCCILENFQKENGVEVPKALQPYMGGIDFLPFQAG

SEQ ID NO: 405 - DNA, 1092 bp, Oryza sativa
atggctttggcccccgcgagctcgggcagtgggccggtggttacggaggtggagatgaacgccggcgccgaccagggtgccaccggcaccgtgcgtgccaccgtcgtgcaggcctgcaccgtgttctacgacacccctgcgactctcgactgcagataaagcagagaaactggtagctgaagcagctggatatggttcacagatagttctatttccagaagtctttgttggtggttaccctcatggatctacctttggactgactattggcaatcgatctgccaagggaaaggaagacttccataaatatcatgcagctgctatagatgtgcctggtattctgaaatagggtccagaggtgacccgcttagctgcattggctggaaaatacaagattttcttggtgatgggggtggttgaaagggtagggtacacactatataatacagtgctcttctttgatcctctggggaaatacctcgggaaacaccgcaaggtcatgcctactggactggaacgagtgttttgggggtttggggatggatctactatacctgtttatgatactccaatagggaagattggtgccgtcatttgctgggaaaacagaatgccacttctcaggacagcaatgtacgctaaagagatatactgtgctccaactgctgatttctcgcctagttggcaggcctccatgacgcatattgccgttgaagggggatgctttgtactttctgcaaaccagttttgtcgcagaaagaactatccaccagcgcctgaatatacttttggtggccttgatgaagagccatccccagaatctgttatttggcctggaggaagttccatcgtctcaccatctggaacagttctggcaggtccaaactatgaaggcgagggcctcctcacagctgacttggagaccttggagaaattgctcgagctaagtttgatttcgacgtcgtgggacactatgcacgacccgaggtgctgagcctgaccgtgaaaaccgaatcaaagctgcccgtttcttttacttctgctgcagagaaaaattctgctgcaaagagtgacggtatctctaggacctga

SEQ ID NO: 406 - protein, 365 aa, Oryza sativa
  misc_feature (116)..(116): Xaa = any naturally occuring amino acid
  misc_feature (215)..(216): Xaa = any naturally occuring amino acid
  misc_feature (309)..(309): Xaa = any naturally occuring amino acid
MALAPASSGSGPVVTEVEMNAGADQGATGTVRATVVQACTVFYDTPATLDCDKAEKLVAEAAGYGSQIVLFPEVFVGGYPHGSTFGLTIGNRSAKGKEDFHKYHAAAIDVPGILKXGPEVTRLAALAGKYKIFLVMGVVERVGYTLYNTVLFFDPLGKYLGKHRKVMPTGLERVFWGFGDGSTIPVYDTPIGKIGAVICWENRMPLLRTAMYAKXXEIYCAPTADFSPSWQASMTHIAVEGGCFVLSANQFCRRKNYPPAPEYTFGGLDEEPSPESVIWPGGSSIVSPSGTVLAGPNYEGEGLLTADLXDLGEIARAKFDFDVVGHYARPEVLSLTVKTESKLPVSFTSAAEKNSAAKSDGISRT

SEQ ID NO: 407 - DNA, 1008 bp, Oryza sativa
atggccatcgccaccgagtcgcagcaggcgcaggtgcaagccgccgccaccgacgccgtcgcggcggcggcggtcgggcgcaaggtggtggacgaggtgtccggctggctgcgcgtgttcgacgacggcaccgtcgaccgcacgtggacgggtccccccgaggtgctcccgctgatgcagccggtgcccgcctacgccgagccgcgcgacggccacacgctgcacgacctccccggcgagcccaacctccgcgtgtacctccccgaggtcgccctcgccgagcggcgcctccccgtcgtcgtgcagctccacggtggcggcttctgcatctcccacccgtcctggctcatgtaccaccacttctacgcgcgcctcgcgtgcgcgctcccggccgtggtggtcgccgtcgagctgcccttggcgcccgagcgccgcctgccggcgcacatcgacaccggcgtcgacgggctccgccggctccgctccatcgcgctgtccgacgccgccgctctcggcgacccggcggcggagctcctccggacggccgccgacttctcgcgggtgttcctcatcggggacagctcgggcggcaacctcgtccaccacgtcggcgcgcgcgtcggcgaggacggggcggacagctgggcgcccctccgcgtcgccggaggcatcccgctccaacccgggttcctcgccatggcgctccccgagggcgccaccaaggaccacccgtacacgtgcccgatggggccgaacgcgccgccgctggagtccgtcccgctgccgccgctgctggtcgccgtcgccgagcacgacctcatccgggacaccaacctcgagtactgcgacgcgctgcgcaccgccggcaaggacgtggaggtgctggtcaaccgcggcatgagccactccttctacctcaacaagtacgccgtcgacatggacccggccaccggcgagaggacccgggagctcgtcgacgccatcaagagcttcgtcgaccgccactag

SEQ ID NO: 408 - protein, 335 aa, Oryza sativa
MAIATESQQAQVQAAATDAVAAAAVGRKVVDEVSGWLRVFDDGTVDRTWTGPPEVLPLMQPVPAYAEPRDGHTLHDLPGEPNLRVYLPEVALAERRLPVVVQLHGGGFCISHPSWLMYHHFYARLACALPAVVVAVELPLAPERRLPAHIDTGVDGLRRLRSIALSDAAALGDPAAELLRTAADFSRVFLIGDSSGGNLVHHVGARVGEDGADSWAPLRVAGGIPLQPGFLAMALPEGATKDHPYTCPMGPNAPPLESVPLPPLLVAVAEHDLIRDTNLEYCDALRTAGKDVEVLVNRGMSHSFYLNKYAVDMDPATGERTRELVDAIKSFVDRH

SEQ ID NO: 409 - DNA, 1098 bp, Oryza sativa
  misc_feature (628)..(628): s = guanine or cytosine
atgggggtggtcagcttctcctcgacttcctccggcgcgtccacggccaccaccgagtccggcggcgccgtgcggatgtcgccggagccggtggtggcggtggcggcggcggctcaacagctaccggtggtgaagggagttgactcggcggatgaggtggtgacgtcgaggccggcggcggcggcggcgcagcagtcgtcgcggtacaagggggtggtgccgcagccgaacgggaggtggggggcgcagatctacgagcggcacgcgcgggtgtggctcgggacgttccccgacgaggaggcggcggcgcgggcctacgacgtggcggcgctccggtaccgggggcgcgacgcggccaccaacttccccggggccgcggcgtcggccgccgagctcgcgttcctcgccgcgcactccaaggccgagatcgtcgacatgctccggaagcacacctacgccgacgagctccgccaggggctccgccgcggccgcggcatgggcgcccgcgcccagcccacgccgtcgtgggcgcgcgagccgctgttcgagaaggccgtgacgcccagcgacgtcggcaagctcaaccgcctcgtggtgcccaagcagcacgccgagaagcacttcccgstccgccgcgcggcgagctccgactccgcctccgccgccgccaccggcaagggcgtgctcctcaacttcgaggacggcgaggggaaggtgtggcgattccggtactcgtactggaacagcagccagagctacgtgctgaccaaggggtggagccgattcgtgagggagaagggcctccgcgccggcgacaccatagtcttctcccgctcggcgtacggccccgacaagctgctcttcatcgactgcaagaagaacaacgcggcggcggcgaccaccacctgcgccggcgacgagaggccaaccacaagcggcgccgaaccacgcgtcgtgaggctcttcggcgtcgacatcgccggcggcgattgccggaagcgggagagggcggtggagatggggcaagaggtcttcctactgaagaggcaatgcgtggttcatcagcgtactcctgccctaggtgccctgctgttatag

SEQ ID NO: 410 - protein, 365 aa, Oryza sativa
MGVVSFSSTSSGASTATTESGGAVRMSPEPVVAVAAAAQQLPVVKGVDSADEVVTSRPAAAAAQQSSRYKGVVPQPNGRWGAQIYERHARVWLGTFPDEEAAARAYDVAALRYRGRDAATNFPGAAASAAELAFLAAHSKAEIVDMLRKHTYADELRQGLRRGRGMGARAQPTPSWAREPLFEKAVTPSDVGKLNRLVVPKQHAEKHFPLRRAASSDSASAAATGKGVLLNFEDGEGKVWRFRYSYWNSSQSYVLTKGWSRFVREKGLRAGDTIVFSRSAYGPDKLLFIDCKKNNAAAATTTCAGDERPTTSGAEPRVVRLFGVDIAGGDCRKRERAVEMGQEVFLLKRQCVVHQRTPALGALLL

SEQ ID NO: 411 - DNA, 831 bp, Oryza sativa
atggcaacaactaccgtcaccacaccaattctctgcaacctcagcgccaagccacgcgacaccctgcgcctgccgacgacgcgttcgccgaacgacggcacgaggcgaacgacgctccacctgagctcgtcaagagcccgcggcgacttgatccgcgccgccgccgccgtctacacggtgaagctcatcgggccggaggggcaggagagcgtgatcaaggtgccggaggacacctacatcctggacgcggccgaggaagccggcgtcgacctgccctactcgtgccgcgccggcgcgtgctccacctgcgccggcaaggtcgtcgagggcggcgtcgaccagtcggaccagtcgttcctcgacgacgcccaggtcggcgccggctacgtgctcacctgcgtcgcgtacccgaccgccaacagcgtcatccagacgcacaaggaggcagacctgtattatagtcccggggcccaggatccacgtgccgccgactcggaacggcgtcaccacgcggccacaccgggccgcgtcgatcgccaccgccccatcaccgcgcaccgacgcctctgccccgccacgccccgcgtggcggccgccgcgccacggcggaaaccaatcggaattcgggaacctcgcggccgggccggcgcgcgccgtattttcgtcgtccgtccgattttcgctgaaatgcgcggggaggtttcgtgccgcgggcggaagtttcgatcgcagcagccgcccggcgcgcgcgtcaccgtccgcaaccgccacccggaaagggcatcccagggccggggtgcacggaactgcttctgcgagctgagctggtag

SEQ ID NO: 412 - protein, 276 aa, Oryza sativa
MATTTVTTPILCNLSAKPRDTLRLPTTRSPNDGTRRTTLHLSSSRARGDLIRAAAAVYTVKLIGPEGQESVIKVPEDTYILDAAEEAGVDLPYSCRAGACSTCAGKVVEGGVDQSDQSFLDDAQVGAGYVLTCVAYPTANSVIQTHKEADLYYSPGAQDPRAADSERRHHAATPGRVDRHRPITAHRRLCPATPRVAAAAPRRKPIGIREPRGRAGARRIFVVRPIFAEMRGEVSCRGRKFRSQQPPGARVTVRNRHPERASQGRGARNCFCELSW

SEQ ID NO: 413 - DNA, 2028 bp, Oryza sativa
atggcggcttacgagcccaagaacattcttataaccggcgctgctggtttcatcgcatcacatgtggcgaaccgcctagtcaggaactatccgcactacaagattgttgtcctcgacaagctcgattactgttccagcctgagcaatctcaacccttcacgtccatcgccgaatttcaagtttgtcaagggtgacattgcaagtgctgatctggtgaactaccttctcacaactgagtcaattgacactatcatgcactttgctgctcagactcatgtggataattcatttggcaattcctttgagtttacaaagaacaatatttatggtacccatgtccttcttgaggcctgcaaggttactggtcagattagaagatttattcatgtgagtactgacgaggtgtacggagaaactgatgaggatgctgtggttggcaaccatgaggcctcacagctgcttccaacaaacccatattcagctacaaaagctggggctgagatgcttgtgatggcttatggaagatcttatggccttcctgtgattacaactcggggcaacaatgtatatgggccaaatcagttccctgagaagctcattcccaaatttattcttttggcaatgagaggcttgccccttcccattcacggtgatggctcaaatgtcagaagctatctgtattgtgaggatgttgctgaagcttttgaggtggttcttcacaaaggagaggttgggcatgtgtacaatattggtactgtgaaggaaaggagggtgattgatgtggccaaggacatatgcaagctctttggcttggacaccgagaaggtcatcagatttgttgagaacaggcctttcaacgaccagagatacttcttggatgatcagaagctgaagaaattgggatgggcagagcgcacactatgggaagaggggttgaagaaaacaattgaatggtacactaacaatcctgattactggggagatgtcgcaggtgccttgctccctcatccaaggatgttgatgacacctggagttgaaaggcataactggactgatgagatcaaatctctttccacttcaccagatgaagctaaggaatctagcactgcggttcctgcagccactgccaaaagcaccagcagtgcccctcaaaaggcctcatacaagttcttgatatatggtaggactggatggattggtggtctacttggtaagatatgtgagaagcaagggattccatatgagtatgggaaaggacgcctggaagagcgctctcagctcttgcaggacattagaaatgtgaagccaactcatgttttcaatgctgctggtgtcactgggaggccaaatgttgactggtgcgagacccataaacaggatactatccgcaccaatgttgttggcaccttgaaccttgctgatgtttgtcgtgagcagggcttgctcatgattaattatgctacaggttgcatatttgagtatgatgctaagcaccccgaaggatcaggaattggttttaaagaggaagataagcccaactttactggttcatattattccaaaactaaagctatggttgaagagctgttgcaagaatatgacaacgtctgtacgcttcgagtcaggatgcccatatcatcagatttgagcaacccccgtaacttcatcacaaagatagctcgttatgacaaggtggtaaacatccccaacagtatgacaattttggatgagcttttgcccatctccattgagatggcgaagcgggactgcaggggcatatggaacttcaccaatcctggggttgtcagccacaacgagatcctggagatgtacaagaaatacctcaaccccgacttcaagtggaccaacttcactcttgaggaacaggccaaggttatagttgcaccaagaagtaacaacgaaatggatgcatcgaagttgaagtccgagttccccgagctactgtccatcaaggattctttggttaagtatgtttttgagccaaacaggaaggttcctgctaactga

SEQ ID NO: 414 - protein, 676 aa, Oryza sativa
  misc_feature (299)..(299): Xaa = any naturally occuring amino acid
MAAYEPKNILITGAAGFIASHVANRLVRNYPHYKIVVLDKLDYCSSLSNLNPSRPSPNFKFVKGDIASADLVNYLLTTESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGLPLPIHGDGSNVRSYLYCEDVAEAFEVVLHKGEVGHVYNIGTVKERRVIDVAKDICKLFGLDTEKVIRFVENRPFNDQRYFLDDQKLKXKLGWAERTLWEEGLKKTIEWYTNNPDYWGDVAGALLPHPRMLMTPGVERHNWTDEIKSLSTSPDEAKESSTAVPAATAKSTSSAPQKASYKFLIYGRTGWIGGLLGKICEKQGIPYEYGKGRLEERSQLLQDIRNVKPTHVFNAAGVTGRPNVDWCETHKQDTIRTNVVGTLNLADVCREQGLLMINYATGCIFEYDAKHPEGSGIGFKEEDKPNFTGSYYSKTKAMVEELLQEYDNVCTLRVRMPISSDLSNPRNFITKIARYDKVVNIPNSMTILDELLPISIEMAKRDCRGIWNFTNPGVVSHNEILEMYKKYLNPDFKWTNFTLEEQAKVIVAPRSNNEMDASKLKSEFPELLSIKDSLVKYVFEPNRKVPAN

SEQ ID NO: 415 - DNA, 2481 bp, Oryza sativa
atggcgagccagggggagccctcgtcgtcggccgatccgaaggggaagaaggactactcgacggcgatcctggagaggaagaagtcgccgaaccggctggtggtggacgaggccaccaatgacgacaactccgtcgtcgcgctgcacccggacaccatggagaggctgcagctcttccgcggcgacaccgtcctcctcaagggcaagaagaggaaagatactatttgcattgtccttgcggacgaaacctgtgaggagcccaagattaggatgaacaaggttgtcaggaagaacctgagggtgcgacttggtgatgttgtttctgtccaccagtgccaggatgtgaaatacgggaaacgtgtgcacattcttccgattgatgatacagttgaaggcattaccgggaacctgtttgatgccttcctgaagccatacttcttagaagcataccgcccagtgaggaaaggagatctcttccttgtcaggggtggaatgagaagtgtggaattcaaagtcatagagactgaccctactgagtattgcatcgttgcaccagatacagaaatattctgtgatggggagcctattaagagggaagatgaggaaaggcttgatgaggttggatatgatgatgttggtggagttagaaagcagatggctcaaatcagagagcttgttgagcttccactgcgtcatccccaacttttcaaatccattggtgtgaagccaccaaagggcatattgctgtatggaccacctggttctggaaaaaccctcattgctcgtgctgttgcaaatgagactggagcctttttctttttgattaatggacctgagattatgtcaaagctagctggagagagtgagagcaatctcaggaaggcatttgaagaagcagagaagaatgcaccatctatcattttcattgatgagattgattccattgctcccaagagagagaagaccaatggagaagtggaacgtcgtattgtttcacagctgttgactcttatggatggactcaaagctcgttctcatgttattgttatgggtgctacaaaccgtcccaacagcattgatcctgctcttcggaggtttggaaggtttgaccgtgagattgacattggtgtccctgatgaggttgggcggcttgaggttcttcgtattcacactaagaacatgaagctagctgaagatgttgatttggaactcattgcgaaggatactcatggatatgttggtgctgatcttgctgccctttgcactgaggctgctcttcagtgcattcgtgagaagatggatatcatagatcttgaggacgagacaatagatgctgagatattgaactcgatggctgtcacaaatgaccatttcaaaaccgcgcttggtacaagcaacccatctgctcttcgtgaaactgttgttgaagttcctaatgtctcatgggaggacattggtgggctggagaatgtcaagagggagctgcaggagcctatttatgtacttgaattcctgcagactgtccaatatccagtggagcacccagagaagttcgagaagtttggaatgtctccatccaaaggagttctgttctatggccctcctggctgtggtaagaccttgttggccaaggcaattgccaatgagtgccaggcaaacttcatcagtgtgaagggcccagagttgctcaccatgtggtttggagagagtgaagctaatgttcgtgagatatttgacaaggcccgccagtctgcgccatgtgtgctcttcttcgacgagcttgactcaattgctactcagagaggaagcagtgtgggtgatgctggaggtgcagctgatagggtgctgaatcagctgttgacagagatggatggcatgaatgccaagaagactgttttcattattggggctacaaacaggcctgacatcatagatccggccttgcttaggccagggcgtctcgatcagctgatctacattccactgcctgatgagcaatctaggctccaaattttcaaagcttgcctcaggaagtcccctgtggcgaaggatgtggacttgaacgctcttgccaagtacacccaaggcttcagtggtgcagatattacagaaatctgtcagcgtgcatgcaaatatgcgattaagagagaacatcgagaagctcatccgtattacaacaaactagatgacattgagagggagaggcggagtaaggagaaccctgaagcgatggaggaagatgaagtcgacgacattgctgagatcaaggcagcccacttcgaggagtcgatgaagtacgcgcgccgcagtgtcagcgatgccgacatccgcaagtaccaggcgttcgcccagacgttgcagcagtctcgcgggtttggcagtgagttccgtttcgagcggacagaagctggtgctggagctgcggctgatccttttgcgtctgctgccgccgtcgctgatgatgacgatttatatagttag

SEQ ID NO: 416 - protein, 826 aa, Oryza sativa
MASQGEPSSSADPKGKKDYSTAILERKKSPNRLVVDEATNDDNSVVALHPDTMERLQLFRGDTVLLKGKKRKDTICIVLADETCEEPKIRMNKVVRKNLRVRLGDVVSVHQCQDVKYGKRVHILPIDDTVEGITGNLFDAFLKPYFLEAYRPVRKGDLFLVRGGMRSVEFKVIETDPTEYCIVAPDTEIFCDGEPIKREDEERLDEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDEIDSIAPKREKTNGEVERRIVSQLLTLMDGLKARSHVIVMGATNRPNSIDPALRRFGRFDREIDIGVPDEVGRLEVLRIHTKNMKLAEDVDLELIAKDTHGYVGADLAALCTEAALQCIREKMDIIDLEDETIDAEILNSMAVTNDHFKTALGTSNPSALRETVVEVPNVSWEDIGGLENVKRELQEPIYVLEFLQTVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEQSRLQIFKACLRKSPVAKDVDLNALAKYTQGFSGADITEICQRACKYAIKREHREAHPYYNKLDDIERERRSKENPEAMEEDEVDDIAEIKAAHFEESMKYARRSVSDADIRKYQAFAQTLQQSRGFGSEFRFERTEAGAGAAADPFASAAAVADDDDLYS

SEQ ID NO: 417 - DNA, 643 bp, Oryza sativa
  misc_feature (451)..(451): y = cytosine or thymine
  misc_feature (452)..(452): r = adenine or guanine
atggagtgcgttatcggggtcgtcggccgcgacttcgcggtggtggccgccgacacatcggcggtgcagagcatcctggtccacaagaccgacgaggacaaggtgatggtgctcgacagccacaagctgatgggcgcgtccggagagcccggcgaccgagggtgcagttcaccgagttcatccagaagaatctccacctgtatcagttccgcaacaacatcccgctcagcaccgccgccaccgccaatttcacccgcggcgagctcgccaccgccctgcggaagagaatccgtactatgtcaacgtgttgcttgctggatatgattcggatgttggtgcctctttgtattacattgactacatcgcaacattccataagatcgaaaagggtgcctttgggtatggctcctacttctgtctctcgctgatggacaagttatatcgtccagayrtgtcagtcgaggaagctgttgatcttgttgacaagtgcattaaagaaattcggctcaggttggtcgttgctcctcaaaacttcataatcaagattgttgataaagagggtgctagggagtatgccaggcgtgcatacaccgacagtccaccggaagctgcaacatcagaagctgcaactgtagcagcctga

SEQ ID NO: 418 - protein, 215 aa, Oryza sativa
  misc_feature (97)..(97): Xaa = any naturally occuring amino acid
  misc_feature (114)..(114): Xaa = any naturally occuring amino acid
  misc_feature (153)..(153): Xaa = any naturally occuring amino acid
MECVIGVVGRDFAVVAADTSAVQSILVHKTDEDKVMVLDSHKLMGASGEPGDRRVQFTEFIQKNLHLYQFRNNIPLSTAATANFTRGELATALRKRXPYYVNVLLAGYDSDVGXASLYYIDYIATFHKIEKGAFGYGSYFCLSLMDKLYRPDXSVEEAVDLVDKCIKEIRLRLVVAPQNFIIKIVDKEGAREYARRAYTDSPPEAATSEAATVAA

SEQ ID NO: 419 - DNA, 739 bp, Oryza sativa
  misc_feature (305)..(305): w = adenine or thymine
atggcggctgctggtgaagcttcaggaggcagggacaagtaccggtcgttcatgtacggcgagggagagaaggacaccgtgtggaggcttggatcccctccaaactacgacgtcgtcaacaagctcttcgaggaagagagaaccaagtaggaatggccagaggggtctctggaggagaaggtccagaggttgctgaagacctgggagatggagctcatccacaaggtgcgacccgaggaccagaagagcgtccactcgcagaaattctgcgcgagcaccaacggggatgagatttctgagccggwaggaggtgatggctatcggcggctacaacgcgttcctgcagacgaaactgccgccggagcaccgcatctatgacccggacaatgagacgctggagtccggcatggccacgttcttgacggcgttcccgcgtggctttgccatcgaggtgctcgacgtctacagtggtccaccacggatcgtcttcaagttccgacactgggggtacatggaggggcccttcaaggagcatcccccccatggcaagcgggtcgagttctttggcatctgcatcttccatgtcgacgaggagatgaaggtggagaagacggagtacttctacgagcgcggcaatttcctcgcgagcttcttgagcacgcctgctgctgctgctgctgctgaggctgcgtcaggctcaggatgccctgtcatgggaggaaactgaagcaatgggtaa

SEQ ID NO: 420 - protein, 241 aa, Oryza sativa
  misc_feature (50)..(50): Xaa = any naturally occuring amino acid
  misc_feature (102)..(102): Xaa = any naturally occuring amino acid
MAAAGEASGGRDKYRSFMYGEGEKDTVWRLGSPPNYDVVNKLFEEERTKXEWPEGSLEEKVQRLLKTWEMELIHKVRPEDQKSVHSQKFCASTNGMRFLSRXEVMAIGGYNAFLQTKLPPEHRIYDPDNETLESGMATFLTAFPRGFAIEVLDVYSGPPRIVFKFRHWGYMEGPFKEHPPHGKRVEFFGICIFHVDEEMKVEKTEYFYERGNFLASFLSTPAAAAAAEAASGSGCPVMGGN

SEQ ID NO: 421 - DNA, 1527 bp, Oryza sativa
atggttcaacccaataatgagcaactcaaccaacctctgcctttagaggtcagaagttatttgtgcatgctggaaatgatgcagcccttaaaattggcccttcataccatgggaatgtggcaattagatcgaatgatcttccatcttcaagtcgagtggcacaatattcaggtcatagagttaaaaacacaggaaccttacataactcctatgttcactatcctgctggaagctctggtggccatgtatcctacaatcctcaaactgaacctgttataacttatccacatagatctgagggagaatttgctcgagggagttcccaaatcgacaacagaactgctgcagtgaaacgaaaaaatcctgtcatttatccagagtatagcatcaatggtgatggttattgtgccggtagctcatcaagtacccagttctctaattatccacagccagctccattttctgagtccttgcatcgtcaaatgcctccaagtgttggcccaattaattggaatgaccagagcttggtaaatcaagaaggaagtcagagaaatgtgagggcacgtcataattttaataatatttcattggaacctagaccagtccattctacttcgaatgtttcccaaagtacatcaatgaaaaggaatggaccatccttttctacgcgaatgagaactatgccttcagaggtgcctctggaatgcactctggagaaatgccttacactatgggaagcagcaactcatctgttcctgtcccaactttacaaggctcttcaagcagtgcaatatttgccagtggtgtctttgcacctaggcatgttcatggtgacactgttcctagctacattcatctgccttctgtagcatcctctagctctacagcgattccccatgaggtgatcattccgagctaccaacctgctacctctgcaactacctcaacacccatgagggccagtcagccattacctgtcagagctgttgcatcttctagacatgcaaggaatgtactcatagggcatgctaacagcggaaggaacagaagggcgagaagctcatactatggtattcagcctttgatgattgatgcacagagcaattgataatgatgcaacaatttgctctccgcgaatcaagagaagcacaagacccccacagggccatgagactggacattgacaatatgagttatgagaggacctgctggctttgggagaatctattggtaatgtctgcacaggcttggtggacgagaaaatctcaggttgtgtgagagaagtgatctattgcagttctgatgaacagcaaaatgatcaagatgatgggaaatgtgcaatttgtctggggaggaatacaaagacaacagtttgctgggaatactgaaatgcaatcacgacttccacaccgactgcgtcaagaagtggttgaaggagaagaactcatgcccaatttgcaagtcggctgctgcataggacacgcgaggacaaacaacaatatggtcctcaaatttgttagtatttag

SEQ ID NO: 422 - protein, 493 aa, Oryza sativa
  misc_feature (16)..(16): Xaa = any naturally occuring amino acid
  misc_feature (231)..(231): Xaa = any naturally occuring amino acid
  misc_feature (368)..(368): Xaa = any naturally occuring amino acid
  misc_feature (401)..(401): Xaa = any naturally occuring amino acid
MVQPNNEQLNQPLPLXGQKLFVHAGNDAALKIGPSYHGNVAIRSNDLPSSSRVAQYSGHRVKNTGTLHNSYVHYPAGSSGGHVSYNPQTEPVITYPHRSEGEFARGSSQIDNRTAAVKRKNPVIYPEYSINGDGYCAGSSSSTQFSNYPQPAPFSESLHRQMPPSVGPINWNDQSLVNQEGSQRNVRARHNFNNISLEPRPVHSTSNVSQSTSMKRNGPSFSTRMRTMPSXGASGMHSGEMPYTMGSSNSSVPVPTLQGSSSSAIFASGVFAPRHVHGDTVPSYIHLPSVASSSSTAIPHEVIIPSYQPATSATTSTPMRASQPLPVRAVASSRHARNVLIGHANSGRNRRARSSYYGIQPLMIDAQXQLIMMQQFALRESREAQDPHRAMRLDIDNMSYXEDLLALGESIGNVCTGLVDEKISGCVREVIYCSSDEQQNDQDDGKCAICLGEEYKDNSLLGILKCNHDFHTDCVKKWLKEKNSCPICKSAAA

SEQ ID NO: 423 - DNA, 1500 bp, Oryza sativa
atggatggacatacaaatggcactaatggttcctgctctaagccatgcgagccattaacagactactgcatccctgattacattctgaatcctgactctgaacaagtcctcgttgatcaggcaccatgttgccctgtagtagtattcatcaactctagaagtggcggccaactcggaagcagtttgatcaaaacgtatcgtgagcttctcaataaagcgcagcaggtttttgatttatcagaagaggctcctgaaaaggtgcttcacagattgtattgcaactttgagaagctcaagtctaatggcgaccctattgcttttcaaattcagagcaacctaagactaattgttgctggtggtgatggcacagcaagttggctgcttggtgtagttagtgaccttaagctctctcacccacctcctattgcaactgtgcctctgggaactggaaacaaccttccattctcatttggatgggggaagaagaacccaaccactgaccaagaggcggtgaaatcatttcttggacaagttaaaaaagcaagagaaatgaatattgatagagttggcatatcatcatgaggatgcgagctccacaggaaggtccatgtgaacctattgctccgttagagctgcctcactcattgcatgcattccaccgtgtatcaggaagcgattcacttaatatggagggctaccacacataccgtggaggattttggaattactttagtatgggggatggatgcacaagtgtcttacgaatttcactctgagaggaagagaaatcccgagaagttcaagaaccagctaacaaatcagcagagtacatatgctaagcttggacttaaacaaggatggtttgctgcttcactaactcacccatcctcgagaacattgctcaacttgcaaaggtgcggatcatgaaaagacctggtggccaatgggaagagcttaagattcctcgcagagcattcgatcaatcgtctgtctgaatctgccaagtttttctggaggactgaatccttggggaacacctggcaccagagagacctgactgcaccatttgtcgacgacggccttatcgaggttgtcggctttcgcgatgcctggcacggtcttgtcttgcttgcccctaatggccatggaactcgtctagcacagcaggcccatagaatccggttcgagttccacaaaggagcagccgagcacacgttcatgaggatcgatggggagccatggaagcagcctcttcccaaggacgatgacaccgtggtcgtcgagatctctcacctccgtcaggtcaccatgctcgccagcgacccgtgcaagtcgaagagcgtcaacgacccctcgtcgccgatgtgctgtagcaaccacgacgacgacgagcgcaacagcttggaggacgaagatgagtgggaggaggggaggaagaagtttggtgcagctgatacgttcaagttccctgatgaggttgatgttgctcaccttagctga

SEQ ID NO: 424 - protein, 499 aa, Oryza sativa
MDGHTNGTNGSCSKPCEPLTDYCIPDYILNPDSEQVLVDQAPCCPVVVFINSRSGGQLGSSLIKTYRELLNKAQQVFDLSEEAPEKVLHRLYCNFEKLKSNGDPIAFQIQSNLRLIVAGGDGTASWLLGVVSDLKLSHPPPIATVPLGTGNNLPFSFGWGKKNPTTDQEAVKSFLGQVKKAREMNIDSWHIIMRMRAPQEGPCEPIAPLELPHSLHAFHRVSGSDSLNMEGYHTYRGGFWNYFSMGGMDAQVSYEFHSERKRNPEKFKNQLTNQQSTYAKLGLKQGWFAASLTHPSSNIAQLAKVRIMKRPGGQWEELKIPRRSIRSIVCLNLPSFSGGLNPWGTPGTRRDLTAPFVDDGLIEVVGFRDAWHGLVLLAPNGHGTRLAQQAHRIRFEFHKGAAEHTFMRIDGEPWKQPLPKDDDTVVVEISHLRQVTMLASDPCKSKSVNDPSSPMCCSNHDDDERNSLEDEDEWEEGRKKFGAADTFKFPDEVDVAHLS

SEQ ID NO: 425 - DNA, 335 bp, Oryza sativa
atggcgctctccgtggagaagacctcgtcggggagggagtacaaggtgaaggacctctcccaggcggacttcggccgcctcgagatcgagctcgccgaggtcgagatgccggggctcatggccaggtcattgctcagcttgagctgtggaaggagaagagcactggcaagtacgagaagaaggtgtacgttcttcccaagcacctcgacgagaaggtggccgccctccacttgggcaagcttggtgccaggctgaccaagctctccaagtcgcaggctgactacatcagcgttccagttgagggtccctacaagcccgcgcactaccggtactag

SEQ ID NO: 426 - protein, 110 aa, Oryza sativa
GALRGEDLVGEGVQGEGPLPGGLRPPRDRARRGRDAGAHGQVIAQLELWKEKSTGKYEKKVYVLPKHLDEKVAALHLGKLGARLTKLSKSQADYISVPVEGPYKPAHYRY

SEQ ID NO: 427 - DNA, 1020 bp, Oryza sativa
atggctctcgtccgccagcgacgccacctgccgcacctcaccctcccgctcgatcacttcgccctccgcccgccgccggcgccgcagcagcagcagcagcccgcagtcgcgccgtccacctcctctgacgtccgcctctcggacttcgagaggatctccgtcctcggccacggcaacggcgggacggtgtacaaggcgcgccaccgacggggttgccccgcgcagcagccgctcgcgctcaagctcttcgccgccggggacctctccgcggcgcgggaggccgagatactcaggctcgcggcggatgccccgcacgtcgtgaggctccacgcggtggtcccgtcggccgccggtggggtggaggagcccgccgcgctggcgctcgagctcatgcccgggggttccctggctgggttgcttcgccgtctcgggcgcccgatgggggagcgccccatcgccgccgtggcgaggcaggcgctactcgggctcgaggcccttcacgcgctccgcatcgtgcaccgcgacctcaagccgtcgaacctgctcctcggcgccgacggcgaggtcaagatcgccgacttcggcgcgggcaaggtcctgcggcggcggctcgacccctgcgcgtcctacgtcgggacggcggcctacatgtccccggagaggttcgacccggaggcctactccggcgactacgacccgtacgccgccgacgtgtggagcctcggggtagcgatccttgagctgtacctcggccacttcccgcttctccccgtggggcagcgccccgactgggcggcgctcatgtgcgccatatgcttcggcgaggcgccggagatgccggccgccgcgtcggaggagttccgggacttcgtgtcgcggtgcctcgagaagaaggccgggcggcgcgcgtcggtcggcgagctgctcgagcacccgttcatcgccgagcgggacgccgccgatgcgcagcgctcgctcgccgcgctcgtcgccgaggcggagcagagcggcgatctatag

SEQ ID NO: 428 - protein, 339 aa, Oryza sativa
MALVRQRRHLPHLTLPLDHFALRPPPAPQQQQQPAVAPSTSSDVRLSDFERISVLGHGNGGTVYKARHRRGCPAQQPLALKLFAAGDLSAAREAEILRLAADAPHVVRLHAVVPSAAGGVEEPAALALELMPGGSLAGLLRRLGRPMGERPIAAVARQALLGLEALHALRIVHRDLKPSNLLLGADGEVKIADFGAGKVLRRRLDPCASYVGTAAYMSPERFDPEAYSGDYDPYAADVWSLGVAILELYLGHFPLLPVGQRPDWAALMCAICFGEAPEMPAAASEEFRDFVSRCLEKKAGRRASVGELLEHPFIAERDAADAQRSLAALVAEAEQSGDL

SEQ ID NO: 429 - DNA, 891 bp, Oryza sativa
atggagacctcgtgcttccttacctccaatgcctcgccggtgaagagcatggtgatgccgtcgccggccggcgtcgtgaaggccaggccgcacgtgctcttcggcggccggcgagcggcgagctcgtcggtgaccacctgctgcagctacaacggcgagggcgcggcgccggcgatcgacccggactggcggtcgttcagggcgcagctctacttcaacgagcagtacgcgaagagcgtgaacccggcggtggcggcggtgagggcgacggcgacgacgccggagccggtgaagatcggcgacaagtgggcgcacccgctagtggagccggagaaggggtgcctgctgatcgcgacggagaagctggacgggtcgcacatcttcgagcgcacggtggtcctcctcctgtccgccggcgtgctgggccccgtgggcgtgatcctgaaccggccgtcgctgatgtcgatcaaggaggcgcaggcggtgttcgcggagacggacatcgcgggggcgttctcggggcggccgctcttcttcggtggcccgctggaggagtgcttcttcctgctggggccgcgggcggcggcggcgggggacgtggtggggaggacggggctgttcgacgaagtgatgcccggggtgcactacgggacgcgggagagcgtggggtgcgcggcggagctggtgaagcgcggcgtggtcggggtgagggacttccgcttcttcgacggcttctgcgggtgggagagggagcagctgcgcgacgaggtgcgcgcgggcttgtggcgcgtggcggcgtgcagccccgccgtgctgggcctcgccaccgtcgtcaagggcggactctgggaggaggtgcagggcctcgtcggagagaggagggtgtggtga

SEQ ID NO: 430 - protein, 296 aa, Oryza sativa
METSCFLTSNASPVKSMVMPSPAGVVKARPHVLFGGRRAASSSVTTCCSYNGEGAAPAIDPDWRSFRAQLYFNEQYAKSVNPAVAAVRATATTPEPVKIGDKWAHPLVEPEKGCLLIATEKLDGSHIFERTVVLLLSAGVLGPVGVILNRPSLMSIKEAQAVFAETDIAGAFSGRPLFFGGPLEECFFLLGPRAAAAGDVVGRTGLFDEVMPGVHYGTRESVGCAAELVKRGVVGVRDFRFFDGFCGWEREQLRDEVRAGLWRVAACSPAVLGLATVVKGGLWEEVQGLVGERRVW

SEQ ID NO: 431 - DNA, 879 bp, Oryza sativa
  misc_feature (301)..(301): k = guanine or thymine
  misc_feature (304)..(304): y = cytosine or thymine
  misc_feature (597)..(597): k = guanine or thymine
  misc_feature (603)..(603): s = guanine or cytosine
atggctcccaggctctgctgctcttctcaattcttgctcgccgtctccttcctggccgccttcgcggccgtctccaacgccggcaaggtggccgtctactgggggcagggggcgggcaacggcgacggcaccctcgccgagacatgcgccaccggcctgtacgacttcgtcaacatcgccttcctcaacgtctacggcagcggccttaccccggtgctcaactcgcgccactgcaatcgacgcggggactgcaagtcgctcagctccgagatcagctcctgccagcagagcggcgtgaagktgyctctctctcggcggcgagagagctcggactcgcgccccctcggcgacgcggtgctcgacggcatcgacttcgacatagagaaggacggtgaccactacgacgagctggcgatggccctctcgtcgaaatgcaacggcgcgtgcgtgctcacggcggcgccgcagtgcccgtacccggacgcccacctcgacgcggcgatcaagaccggggtgttcagccacgtttgggtgcagttctacaacaaccggcagtgccagtacgccagcggcgacgcgagcgcgctgcaggccgcktgggcscagtggaccgagcggcgtgccggcgcccgcggacgtcttcctgggcctgccgacggcgccggccgctgcaccgagcggaggctacatcgacgcggacacgctgctgtcgcaggtgctaccggcggtggagggcgcggcggcgaactacggcggagtcatgctgtggaatcgctggagagacgtgaccgctggttatggcgccaagttgaaggggaaagtttgaaacaaattaagctacgcctacgaaccattcatattcacaggcgtttgaaataa

SEQ ID NO: 432 - protein, 292 aa, Oryza sativa
MAPRLCCSSQFLLAVSFLAAFAAVSNAGKVAVYWGQGAGNGDGTLAETCATGLYDFVNIAFLNVYGSGLTPVLNSRHCNRRGDCKSLSSEISSCQQSGVKLALSRRRESSDSRPLGDAVLDGIDFDIEKDGDHYDELAMALSSKCNGACVLTAAPQCPYPDAHLDAAIKTGVFSHVWVQFYNNRQCQYASGDASALQAAWAQWTERRAGARGRLPGPADGAGRCTERRLHRRGHAAVAGATGGGGRGGELRRSHAVESLERRDRWLWRQVEGESLKQIKLRLRTIHIHRRLK

SEQ ID NO: 433 - DNA, 2160 bp, Oryza sativa
  misc_feature (1426)..(1426): w = adenine or thymine
atggagattaattcctctggtgaggaagcggtggtaaaggtgaggaagccatacacaatcacaaagcagagggagcgttggactgaggcagagcacaacaggttccttgaagccttgaaactgtatgggagagcctggcagcgcatagaaggtctcattgcaagatctatgaatggggaggaacacaagcaaggcagacataatccgttggaaaaggaagctatcaacaatggcacttctccaggacaagctcatgacatcgacatacctccaccacgaccaaaaagaaaacctaacagtccatatcctcgaaaaagttgtctcagctctgagacatccaccagggaagttcaaaatgataaggcaacaatatcaaatatgacgaacaatagcactgcacaaatggcaggtgatgcagctcttgagaaactcacttacattcagaaacttcaaagaaaggagatatctgaaaaaggaagttgctccgaagttcttaatctctttcgagaagtcccatcggcatcattttcttcagttaacaaaagctcttcaaatcatggtgcatccagggggctggaaccgactaaaacagaagtcaaagatgtggtcatcttggaaagggattctatttccaatggtgcagggaaggatgcaaaagatatcaatgatcaagaaatggaaaggctcaatgggatacacatcagctcgaagcctgatcattctcatgaaaactgtttggatacctcaagccaacaatttaagccaaaatcaaactctgtggagacaacatatgtggattggtctgctgcaaaagcttcacactaccaaatggacagaaatggggttactggctttcaagccactggaactgaaggaagccatcctgatcaaacaagtgatcaaatgggaggagccagcggaactatgaatcaatgcatccatccaacacttcctgtggatccaaaattcgacggcaatgccgcagcacagccctttcctcacaactatgcagcctttgcaccaatgatgcaatgccactgcaaccaagatgcctacagatcttttgccaatatgtcatccaccttctccagcatgcttgtctccacattgttgtcaaaccctgcaatccatgcagctgccaggcttgcagcatcgtactggcctacagtagacggcaatactcctgatccaaatcaagaaaatctttctgagagtgctcaaggaagccacgctggctctcctcccaacatggcatctattgtcacagctacagttgctgcagcatcagcatggtgggcaacacaagagactgatgagagtggaaaaggagaagtgtcgctccacactgagttaaagatatctccagcagataaggccgacaccaaacctgccgcaggagctgaaacaagtgacgtttttggaaatwagaaaaagcaggatcgctcttcatgtggttccaacacaccgtcaagtagtgatatagaagcagataatgctcctgagaatcaagaaaaggctaacgacaaggcaaagcaagcatcttgcagtaactcttcagccggtgacaataaccaccgtagatttaggagcagtgcaagcacaagtgattcatggaaggaagtttctgaagaggtggtcgtctaccagcattccgcatattcacatttatcttactcgctgaacatccatcactgcttttctaattcacatttctgctgtcagggtcgtctggcttttgatgcactgttcagtagagaaaggcttccccaaagcttttctcctccgcaagtagaaggatcaaaggagattagcaaggaggaagaagatgaagtaaccacggtgacggttgacctcaacaagaatgccgctattattgatcaagaactcgacacagcggatgagccaagagcttcctttcctaatgaattgtcaaacctgaagctgaaatctcgcaggaccggtttcaaaccatacaagaggtgctcagtggaagcgaaggagaacagggtaccggctagcgatgagggggaaacagggtgccagagtgggaagaacgtgttcaacgtgcccacttgcaagcatggacaggctggtgctgtgtacaacttcttctctgctacccaacaggggaaaatgcgtgactatgaaaggttgatgtga

SEQ ID NO: 434 - protein, 719 aa, Oryza sativa
MEINSSGEEAVVKVRKPYTITKQRERWTEAEHNRFLEALKLYGRAWQRIEGLIARSMNGEEHKQGRHNPLEKEAINNGTSPGQAHDIDIPPPRPKRKPNSPYPRKSCLSSETSTREVQNDKATISNMTNNSTAQMAGDAALEKLTYIQKLQRKEISEKGSCSEVLNLFREVPSASFSSVNKSSSNHGASRGLEPTKTEVKDVVILERDSISNGAGKDAKDINDQEMERLNGIHISSKPDHSHENCLDTSSQQFKPKSNSVETTYVDWSAAKASHYQMDRNGVTGFQATGTEGSHPDQTSDQMGGASGTMNQCIHPTLPVDPKFDGNAAAQPFPHNYAAFAPMMQCHCNQDAYRSFANMSSTFSSMLVSTLLSNPAIHAAARLAASYWPTVDGNTPDPNQENLSESAQGSHAGSPPNMASIVTATVAAASAWWATQETDESGKGEVSLHTELKISPADKADTKPAAGAETSDVFGNEKKQDRSSCGSNTPSSSDIEADNAPENQEKANDKAKQASCSNSSAGDNNHRRFRSSASTSDSWKEVSEEVVVYQHSAYSHLSYSLNIHHCFSNSHFCCQGRLAFDALFSRERLPQSFSPPQVEGSKEISKEEEDEVTTVTVDLNKNAAIIDQELDTADEPRASFPNELSNLKLKSRRTGFKPYKRCSVEAKENRVPASDEGETGCQSGKNVFNVPTCKHGQAGAVYNFFSATQQGKMRDYERLM

SEQ ID NO: 435 - DNA, 3172 bp, Oryza sativa
  misc_feature (2371)..(2371): w = adenine or thymine
  misc_feature (2385)..(2385): r = adenine or guanine
  misc_feature (2686)..(2686): m = adenine or cytosine
atggttgtcggcacggtgggcgcgctcggcaacggcatctcgcagcccctcatgacggtcctcttcggcaacgtcatcaactccttcggcgcgaacaccagcggcagcgtcctccgcagcgtgaccaagctcaacttcatatatctgggaattggaacttcagtagcttcctttcttcggagaaaggcagtctgcccgcatccgttctttatacctgaaagccgttctgaggcaggatattacattcttcgacacagagatgacaactggtgaagcagtttctagaatgtctagtgataccctcctaattcaaggtgctcttggtgagaagtcaagcttcatcggtggctttatcatagcattcactagaggatggcttctcactcttgtcatgctaacatcgctaccgttaattgctattgccagtgcagtttctgcacaggccctaactagagtttctagcaagagacaaacatcatatagtgatgctggggacacagttgaacagaccattggatctataagaacagttgtgtccttcaatggtgagaagaaagcgatagcaatgtaccgtaattttataaagaagtcatacaaggctactattgaggaaggcattatcactggttttggcatgggctctgtcatgtgcgtcgtatttggcagctatggattagccttctggtatggtggaaagctaatcattgagaaagggtcaatctgcagcatacaatttgttcaaaacaattgagaggaaaccagagatagattccgatgataacaatggcatggttttagaagatatgaatggcgatattgagctaaaggatgtgtactttcgttaccctgcaagaccagagcagttgatattggatggattgtcgttacaagtagcgagtggaacaacaatggctatagtcggagagagtggaagcggaaagtcaactgttatcagcctagtcgaaagattctacgatccacagtctggcgaagttttaatagatggaattagcatcaagaaactgagacttgattggataagagggaagatcggtcttgttagccaagagcctctgctttttatggcctccattaaagataacataatatatggtaaaaaagatgcaacgcttgaagagatcaagagagcagcggagcttgcaaatgcagctaacttcattgacaagttaccaaatcagggttatgatactttagttggccagcgcggtactcagctctctggaggacaaaaacagagaattgcaattgcaagagccatcctcaaagatccaaaaatccttttgctcgatgaagcaacaagtgcacttgatgtggagtctgagaggatagttcaggaggcactaaatagaatgatggtagaaagaaccacactcgttgtcgctcatcgtttgagcactgtgaggaatgttgattgcatcacagtcgtccgcaaaggaaaaatagttgaacaaggtaaggatcccgatggagcttactcccagcttaataagccagaagtgccagttcttttgttaggttctatagcagcatcagtgcatggagtcattttgccactatacggtataataatgccaggtgttctaaaatcattctatgaaccgccagatcagctgcgaaaagattctagattttgggcattgatgtctgttgttctgggggttgcttgtttgatttcaatcccagcagaatattttttgtttggaattgctgggggaaagcttatacagcgtgtccgtacactgtcatttcaaagaattatgcaccaagaggttgcttggtttgataagccctccaattccagggtacaaggctctcagtcgatgcgttgaatgtccgccgtttagtaggagataacctggcccttatagtccaggctgtagctacactaatcactggctttgccatagcttttgcggcagattggaggcttgcactgatcatcacttgtgtaattcctttagtgggtgcacagggctatgctcaagttaagttcttgaaggggttcagtgaagaatctaagtatgaggatgcaaaccaagttgcggctgacgctgtaggcagcatcagaactgtagcatctttctgttcagagaaaagagtggtggcaatatacaacaagaaatgtgaagctttaagaaaacagggaattcgaagcggaatcgttggagggattggcttaagtttctcaaacttgatgttatatctgacttacggtctttgcttctatgttggtgcaaagttcgtaagtcagggaaaaactactttttcagatgttttcaaagatgcttttcaggttttctttgctttagttttggcagccgttggtgtttcgcagtcaagtgcattgtcwactaatgcaacaarggcaagggattctgccatttccatttttagtattatcgatcggaagtctaggattgattcaagtagcgacgagggagcgataatggaaaacgtcactggcagcattgatttcaataataccatagcacttgttggagaaagcggtagtgggaagtccacgataattgctttattagagcgtttctatgatcctgattctggtaatatctcactagatggagttgaaattagaagcttaaaagtcagctggttgagggatcagatggggcttgtaggccaggagccagtgcttttcaacgamacaatccgtgccaacataacatacgggaaacacagtgagacagaggaagagatcactgctgtggccaaggcagcaaacgcccatgagttcgtatcaagcctgccacaaggatacgacacagtggtaggtgagaaaggggtgcaactatctggtgggcaaaaacagagggtagcaattgcaagggccatcctaaaggaccctaagatactgctacttgatgaggcaaccagtgctctagatgcagaatcagaacgtgttgttcaagatgcattggatcgagtcatggtcaacaggactaccattgtagtggcacaccgcctctccacaatcaaaggggctgatatgattgcagtcctcaaggaaggaaaaattgcagaaaaaggaaagcatgaagcactattgcggatcaaggatggtgcatatgcttcacttgtacaactccgctctaattccgagtaaaatgatgtatattttgatggtgtataa

SEQ ID NO: 436 - protein, 615 aa, Oryza sativa
SLRKGQSAAYNLFKTIERKPEIDSDDNNGMVLEDMNGDIELKDVYFRYPARPEQLILDGLSLQVASGTTMAIVGESGSGKSTVISLVERFYDPQSGEVLIDGISIKKLRLDWIRGKIGLVSQEPLLFMASIKDNIIYGKKDATLEEIKRAAELANAANFIDKLPNQGYDTLVGQRGTQLSGGQKQRIAIARAILKDPKILLLDEATSALDVESERIVQEALNRMMVERTTLVVAHRLSTVRNVDCITVVRKGKIVEQGDNNGMVLEDMNGDIELKDVYFRYPARPEQLILDGLSLQVASGTTMAIVGESGSGKSTVISLVERFYDPQSGEVLIDGISIKKLRLDWIRGKIGLVSQEPLLFMASIKDNIIYGKKDATLEEIKRAAELANAANFIDKLPNQGYDTLVGQRGTQLSGGQKQRIAIARAILKDPKILLLDEATSALDVESERIVQEALNRMMVERTTLVVAHRLSTVRNVDCITVVRKGKIVEQGKDPDGAYSQLNKPEVPVLLLGSIAASVHGVILPLYGIIMPGVLKSFYEPPDQLRKDSRFWALMSVVLGVACLISIPAEYFLFGIAGGKLIQRVRTLSFQRIMHQEVAWFDKPSNSRVQGSQSMR

SEQ ID NO: 437 - DNA, 1077 bp, Oryza sativa
atgtctgaggtgtccgttatggccgaggtggaggagacggcggcggcggcgccgctggacctgccgccggggttcaggttccaccccaccgacgaggagatcgtctcgcactacctcacccccaaggccctcaaccaccgcttctcctccggcgtcatcggcgacgtcgacctcaacaagtgcgagccatggcacctcccagccatggcgaagatgggggagaaggagtggtacttcttctgccacaaggaccgcaagtacccgaccgggacgaggacgaaccgggcgacggagagcggctactggaaggccaccggcaaggacaaggagatcttccgcgggaggggcatcctcgtcggcatgaagaagacgctcgtcttctacctcggccgcgcgccccgtggcgagaagaccggctgggtgatgcacgagttccgcctcgagggcaagctccccagccagctcccgcgctccgccaaggaccagtgggcggtgtgcaaggtgttcaacaaggagttggcgctggcggcgaagaacgggccaatggcggtgaccgaagcgaccgccgacgacgcggggatcgagcgggtcggctcgttcagcttcctcagcgacttcatcgaccccgccgagctgccgccgctgatggacccttccttcgtcgccgacatcgacggggtggacgacgccaaggtgtccgcgtcgacctccgggcaggccgcgatcgccgccggcttccatgtcgcgtcgcaggtcatgagctaccagcaggtcaagatggaagagccgttgccgctgccgtacctgcaccagcagccgccgcggatgctgcactcgggtcagtacttctcgctcccggcggtgcaccccggcgacctgacgccgtcggcgatccggaggtactgcaaggcggagcaggtctcggggcagacgtcggcgctcagcgcctcgcgcgacaccgggctcagcaccgaccccaacgccgccggctgcgcggagatctcgtcggcgccgacgtcccagccgttcccggagttcgacgacgggattctgggcctcgacgacttctggaactaa

SEQ ID NO: 438 - protein, 358 aa, Oryza sativa
MSEVSVMAEVEETAAAAPLDLPPGFRFHPTDEEIVSHYLTPKALNHRFSSGVIGDVDLNKCEPWHLPAMAKMGEKEWYFFCHKDRKYPTGTRTNRATESGYWKATGKDKEIFRGRGILVGMKKTLVFYLGRAPRGEKTGWVMHEFRLEGKLPSQLPRSAKDQWAVCKVFNKELALAAKNGPMAVTEATADDAGIERVGSFSFLSDFIDPAELPPLMDPSFVADIDGVDDAKVSASTSGQAAIAAGFHVASQVMSYQQVKMEEPLPLPYLHQQPPRMLHSGQYFSLPAVHPGDLTPSAIRRYCKAEQVSGQTSALSASRDTGLSTDPNAAGCAEISSAPTSQPFPEFDDGILGLDDFWN

SEQ ID NO: 439 - DNA, 183 bp, Oryza sativa
atgggatctaggcgccgacggcggatccacacgagcatgaatgacggcttggagccggtggatgatctagtcggcgacaactcggaggggaggacggcgttgcgacctcaagagaaggcctccaccgccaagctcctaccggtgtcgacgcggcctccaaccccgagcaaccgctgcctctag

SEQ ID NO: 440 - protein, 60 aa, Oryza sativa
MGSRRRRRIHTSMNDGLEPVDDLVGDNSEGRTALRPQEKASTAKLLPVSTRPPTPSNRCL

SEQ ID NO: 441 - DNA, 835 bp, Oryza sativa
atggccgaggcggcgtcggcggcggcggcggcgacgacggagcaggcgaatgggagcagcggcggcgagcagaagacgcggcactcggaggtcggccacaagagcctcctcaagagcgacgatctctaccagcagtacatcctggagacgagcgtgtacccgcgcgagcacgagtgcatgaaggagctccgcgaggtcaccgccaaccacccatgggaacctgatgacgacgtcggcggacgaggggcaattcctgaacctgctgctgaagctcatcggcgccaagaagaccatggagatcggcgtctacaccggctactccctcctcgccaccgccctcgccatccccgacgacggcacggatcttggcgatggacatcaaccgggagaactacgagctggggctcccgtcgatcgagaaggcgggagtggcgcacaagatcgacttccgggagggacccgcgctgccggtgctggaccagctggtggaggaggagggcaaccatgggtcgttcgacttcgtgttcgtcgacgccgacaaggacaactacctcaactaccacgagcggctgatgaagctggtcaaggtcggcggcctcgtcggctacgacaacacgctctggaacggctccgtcgtgctccccgccgacgcccccatgcgcaagtacatccgctactaccgcgacttcgtgctcgagctcaacaaggccctcgccgccgaccaccgcgtcgagatctgccagctccccgtcggcgacggcatcaccctctgccgccgcgtcaagtgagcccgccgccgccgcgagtgcgactccggccgatgcccaagaactag

SEQ ID NO: 442 - protein, 261 aa, Oryza sativa
MAEAASAAAAATTEQANGSSGGEQKTRHSEVGHKSLLKSDDLYQQYILETSVYPREHECMKELREVTANHPWNLMTTSADEGQFLNLLLKLIGAKKTMEIGVYTGYSLLATALAIPDDGRILAMDINRENYELGLPSIEKAGVAHKIDFREGPALPVLDQLVEEEGNHGSFDFVFVDADKDNYLNYHERLMKLVKVGGLVGYDNTLWNGSVVLPADAPMRKYIRYYRDFVLELNKALAADHRVEICQLPVGDGITLCRRVK

SEQ ID NO: 443 - DNA, 1466 bp, Oryza sativa
  misc_feature (19)..(19): b = cytosine, guanine, or thymine
  misc_feature (21)..(21): n = any nucleotide
  misc_feature (393)..(393): r = adenine or guanine
  misc_feature (421)..(421): s = guanine or cytosine
  misc_feature (1085)..(1085): m = adenine or cytosine
atgaggatttccagggctbtngcggcggccgcgctgctgctgctgctgtcgctggcagcggcggacatgtcgatcgtgtcgtacggggagaggagcgaggaggaggcgcggcggctgtacgcggagtggaaggccgagcacggcaagagctacaacgccgtcggcgaggaggagcggcggtacgcggcgttcagggacaacctccggtacatcgacgagcacaacgccgccgccgacgccggggtccactccttccgcctcggcctcaaccgcttcgccgacctcaccaacgaggagtaccgggacacctacctcggcctcaggaacaagccgcggagggagaggaaggtcagcgacaggtacctcgccgccaacaacgaggcgctgccggartccgttgactggaggaccaagggggccstggctgagatcaaggaccagggaggttgcgggaagttgctgggctttctcagcaatagcagctgtagaaggcatcaaccagattgttactggcgacctgatatctttgtctgagcaggagctagttgactgtgacacttcatataacgagggatgcaatggaggtctgatggactatgcatttgatttcatcatcaacaatggtggaatcgacaccgaggatgactacccttacaaaggcaaggacgaacggtgtgacgtaaacaggaaaaacgcaaaggttgtcacaattgacagctacgaagatgtaacaccaaacagtgagacgagtctgcagaaggcggtagcaaaccagcccgtcagtgttgcaattgaagccggtggcagagcattccagctctactcatcgtcttagggtatcttcacgggtaaatgtggaacagcactagaccacggcgtcgctgctgttgggtacggcacagagaatggcaaggactactggatcgtgaggaactcgtggggcaagagctggggtgagtccggctacgtccgtatggagcgcaacatcaaggcgagcagtggcaagtgcggcattgccgttgagccatcctaccctctgaagaagggcgagaacccccgaacccgggccctactccgccgtcccmaaccccgcctcccaccgtctgcgacaactactacacttgccccgatagcaccacctgctgctgcatctacgagtatggcaaatactgctacgcctggggctgctgcccactcgagggcgccacctgctgcgatgatcactacagctgctgccctcacgagtaccccatctgcaatgttcagcagggaacctgcctcatggcgtggggtgggcggatggcacggtcctcaccacgtgcagcagcggagccagctcccgggtaggccaggcacggtcaccactcaccacgtccaccgttaccttcttcactgccgataataactatcaacacctataaaaattagttgattacataaaaacgttatttgtcgtttgtgtttga

SEQ ID NO: 444 - protein, 466 aa, Oryza sativa
  misc_feature (7)..(7): Xaa = any naturally occuring amino acid
  misc_feature (141)..(141): Xaa = any naturally occuring amino acid
  misc_feature (278)..(278): Xaa = any naturally occuring amino acid
  misc_feature (362)..(362): Xaa = any naturally occuring amino acid
MRISRAXAAAALLLLLSLAAADMSIVSYGERSEEEARRLYAEWKAEHGKSYNAVGEEERRYAAFRDNLRYIDEHNAAADAGVHSFRLGLNRFADLTNEEYRDTYLGLRNKPRRERKVSDRYLAANNEALPESVDWRTKGAXAEIKDQGGCGSCWAFSAIAAVEGINQIVTGDLISLSEQELVDCDTSYNEGCNGGLMDYAFDFIINNGGIDTEDDYPYKGKDERCDVNRKNAKVVTIDSYEDVTPNSETSLQKAVANQPVSVAIEAGGRAFQLYSSSXGIFTGKCGTALDHGVAAVGYGTENGKDYWIVRNSWGKSWGESGYVRMERNIKASSGKCGIAVEPSYPLKKGENPPNPGPTPPSXTPPPTVCDNYYTCPDSTTCCCIYEYGKYCYAWGCCPLEGATCCDDHYSCCPHEYPICNVQQGTCLMAGVGGWHGPHHVQQRSQLPGRPGTVTTHHVHRYLLHCR

SEQ ID NO: 445 - DNA, 1933 bp, Oryza sativa
  misc_feature (22)..(22): m = adenine or cytosine
  misc_feature (24)..(24): s = guanine or cytosine
  misc_feature (27)..(27): m = adenine or cytosine
  misc_feature (40)..(40): y = cytosine or thymine
  misc_feature (44)..(44): y = cytosine or thymine
  misc_feature (58)..(58): y = cytosine or thymine
  misc_feature (70)..(70): y = cytosine or thymine
  misc_feature (76)..(76): s = guanine or cytosine
  misc_feature (93)..(93): m = adenine or cytosine
  misc_feature (170)..(170): y = cytosine or thymine
atggagtcgctcgcgttcttcmasgcmaagcccggcggcytccytccccgcgcggggytccgcttcccgytcccgsgcgcgcgatccgcgcgmgtctccttcccttcttccccggcggcccccgtatcgctccagtcccggtcctcctggcttcgagaagcggccttacytcgcgggacgccgtccttgggttgggattggggtgcgggctcttgagacggaggagcggcgctagtggtggtggtggtggtggggtctcttgcggcgcgcagcctgccgcggcggcggcggcgggggcggtgccggcggcgcagccggaggggaagaagttcctcggcgtggaggtgaagacgctgaagaagatcgtgccgctcgggttgatgttcttctgcatcttgttcaactacacgatcctgcgggacaccaaggacgtgctggtggtgaccgccaaggggagcagcgcggagatcatcccgttcctcaagacgtgggtcaacctgcccatggccatcggcttcatgctcctctacaccaagctctccaatgtgctctccagggaggcgctcttctacaccgtcatcttccccttcatcgccttcttcggcgcctttgccttcgtgctctaccctctcaggaatgtgatccaccccaccgcgctcgccgacaagctccttgcggcgctcggcccgagctttcttggccccgtcgccattctgaggatttggagcttttgcttgttctatgtcatggccgaactgtggggcagcgtcgtcatctcggtcctcttctggggcttcgctaaccagcagattactacagttgaggaagcaaaagaattctaccctctatttggtcttggggctaatattgcgctcatcttttctgggcgtactgtgaagtatttctcaaatctgcgcaagacattgggtccaggtattgacggatgggaggtgtctttgaaaggaatgatgagcttagtggtgcttcttggacttgtcatcacttccatctattggggggtgaacaagtttgttttgaatgatccttctcttccgaagtctgaccgtaagaagaaaaagaggataaacctaagcttggaatgaaagagagtcttaaagttctcctctcctcaagatatgtaagggaccttgctactttagtggttgcatatggcatcagtatcaaccttgtggaggtcacatggaaatcgaagctcaaggcacaggcagttccctagtccaaatgagtattcatctttcatgggtgatttctcaaccgctactggcattgctactttcacaatgatgctgttaggccggatcatactccgaaaattcggctggggagtggctgcaatgatcacccccacagttttgttgctgactggcgtcggtttcttctccctgattctatttgggcagcctctcactcctatgcttgccacaatgggcatgacccctcttcttgcagcagtttatgtgggtgcacttcagaacatattcagcaagagtgcaaagtatagtttatttgatccatgcaaagaaatggcctacattcctttggatgaagatatgaaggtgaagggaaaggcagccattgatgttgtctgcaacccattggggaagtctggtggagctcttattcaacagttcatgatccttacatttggctctttagctaactccaccccctaccttggtggcatactgttggtgattgttctagcatggctaggcgcggcaagttcactagacaagcaattctctagcttggctaaggaagatctcaaaagggatatgtctgcaaaagagaaggtagatccttccctgctcaaggctcctgaggctgatgtattggtggagcacacaaacggcactatagagagcgaagctactgcaactgagagttcaccatcaaactcatctccaagtaa

SEQ ID NO: 446 - protein, 643 aa, Oryza sativa
  misc_feature (8)..(8): Xaa = any naturally occuring amino acid
  misc_feature (14)..(15): Xaa = any naturally occuring amino acid
  misc_feature (20)..(20): Xaa = any naturally occuring amino acid
  misc_feature (24)..(24): Xaa = any naturally occuring amino acid
  misc_feature (26)..(26): Xaa = any naturally occuring amino acid
  misc_feature (360)..(360): Xaa = any naturally occuring amino acid
MESLAFFXAKPGGXXPRAGXRFPXPXARSARVSFPSSPAAPVSLQSVLLASRSGLTSRDAVLGLGLGCGLLRRRSGASGGGGGGVSCGAQPAAAAAAGAVPAAQPEGKKFLGVEVKTLKKIVPLGLMFFCILFNYTILRDTKDVLVVTAKGSSAEIIPFLKTWVNLPMAIGFMLLYTKLSNVLSREALFYTVIFPFIAFFGAFAFVLYPLRNVIHPTALADKLLAALGPSFLGPVAILRIWSFCLFYVMAELWGSVVISVLFWGFANQQITTVEEAKEFYPLFGLGANIALIFSGRTVKYFSNLRKTLGPGIDGWEVSLKGMMSLVVLLGLVITSIYWGVNKFVLNDPSLPKSDRKKKKXDKPKLGMKESLKVLLSSRYVRDLATLVVAYGISINLVEVTWKSKLKAQQFPSPNEYSSFMGDFSTATGIATFTMMLLGRIILRKFGWGVAAMITPTVLLLTGVGFFSLILFGQPLTPMLATMGMTPLLAAVYVGALQNIFSKSAKYSLFDPCKEMAYIPLDEDMKVKGKAAIDVVCNPLGKSGGALIQQFMILTFGSLANSTPYLGGILLVIVLAWLGAASSLDKQFSSLAKEDLKRDMSAKEKVDPSLLKAPEADVLVEHTNGTIESEATATESSPSNSSPS

SEQ ID NO: 447 - DNA, 2013 bp, Oryza sativa
  misc_feature (1884)..(1884): n = any nucleotide
  misc_feature (1905)..(1905): k = guanine or thymine
  misc_feature (1963)..(1963): r = adenine or guanine
atggcgccgccgccgccgtcgccgccgtgccggccgcgagtcaagcccgagcgcgcccttctgtgcttctccctcctcctcctcctgaccgccaccacggcgaacgccagcatcaccgactgcccaactacaagcagcaccaactccagccatgtcgacgacggtgccttcggggccaacctccgcgctctcctctcctccctttccgcagccgcggcggcatcgtcgtcggggttcgccgagaacgcgaccggcgcggcgccggacacggcgtacggcctcgcgcagtgccgcggcggcatcgtcggcggcggcaatggcaccagctgccgctcctgcctcgacgactcggtgcgggacgcggccaaggcgtgccccggcgagaaatccgccgtgatcatctccgactactgcctcgtccggtactccaacgcgagcttcgccggcgccgccgacgagcggacggtgaagctctggtggaacacggacaacgcgacgcagccggagaggttcaagtcgctgctggggacgctgatgggcaacctcaccgacgccggcggcgcgcgcttcgtcgccgctgattgcacccgcgacctcgccgccggcgactgctaccgctgcctcgtcggcgccgtcaacaacatcccgaaatgctgcgacgggaagcagggcgggcaggtcatcacgaggagctgctccatccggttcgaggtgtacccgttcttcgacgcccaggccgccaaggcggccatgtcgcctgcgccggcgccggcgccggtgacgacgcccaccggggtcaatggaagtaatcacacagtcagtaagtctgtgattgtcccagttactgtgggagttgccgtgttactagtggtaatactgctgctaattgccctttgtctgtgcaagaggaacagaaaaccacataagcatatgatgattggaagcgtcgatcttggagatgaagacgaaatgagaggctcagaatctctcttgtatgatttgagtactctaagagcagcaactgccaacttctcagaagaaaataagctcggagaaggtggatttggcccagtctacaaaggtacactgcaaaatggtcaagagattgcagtgaagagattgtcagcaacttcccatcaagggcaattggagatgaagaatgaggtagtcttggttgcaaagcttcagcacaagaatctggtcaggctgctaggatgctgcatcgaagaacgggagaaaatcctagtttatgagttcctctgtaacaaaagcctcgacactatccttttcgacacttcaagacagcaagaccttaactgggagcaaagattcaagatcattgaagggatcggaagagggcttctttatcttcatgaagattcaaggctcaagatcatccaccgtgatctcaaagctagcaacatcttgttagatgtagacatgaaccccaagatatcagacttcggccttgccaagttatttaacatggaagcgagcgtagcaaacactagcaggattgctggaacctacggatacatggcgccggagtacgcgctgcacggcatcttctcggccaaatccgacgtcttcagctacggcgtgctcctcctcgagatcgtcaccggccgccgcaacacctgcctccatgactccgaggatctcctggcatttgtaatccccgcgcaaatcctatctaaagtctggaggcactggagccgcggcggcgccggggagctgctcgacggctgccccgccgccggccgccggccgcaggagcttctgcggtgcatccacgtggggctcctctgcgtgcaggaggacccgcagctccgccccggcatggcggcagtcgtcgtcatgctcaacagccgctcggtcacgctnccggcgccctcggcgccggckttcgtctccgcgagccgtgggatcggcggaagcccgccgccggcggcgccgccggaarattccccggcaaggaccacggatcacgaggttcctacggctgctcgatag

SEQ ID NO: 448 - protein, 670 aa, Oryza sativa
MAPPPPSPPCRPRVKPERALLCFSLLLLLTATTANASITDCPTTSSTNSSHVDDGAFGANLRALLSSLSAAAAASSSGFAENATGAAPDTAYGLAQCRGGIVGGGNGTSCRSCLDDSVRDAAKACPGEKSAVIISDYCLVRYSNASFAGAADERTVKLWWNTDNATQPERFKSLLGTLMGNLTDAGGARFVAADCTRDLAAGDCYRCLVGAVNNIPKCCDGKQGGQVITRSCSIRFEVYPFFDAQAAKAAMSPAPAPAPVTTPTGVNGSNHTVSKSVIVPVTVGVAVLLVVILLLIALCLCKRNRKPHKHMMIGSVDLGDEDEMRGSESLLYDLSTLRAATANFSEENKLGEGGFGPVYKGTLQNGQEIAVKRLSATSHQGQLEMKNEVVLVAKLQHKNLVRLLGCCIEEREKILVYEFLCNKSLDTILFDTSRQQDLNWEQRFKIIEGIGRGLLYLHEDSRLKIIHRDLKASNILLDVDMNPKISDFGLAKLFNMEASVANTSRIAGTYGYMAPEYALHGIFSAKSDVFSYGVLLLEIVTGRRNTCLHDSEDLLAFVIPAQILSKVWRHWSRGGAGELLDGCPAAGRRPQELLRCIHVGLLCVQEDPQLRPGMAAVVVMLNSRSVTLPAPSAPAFVSASRGIGGSPPPAAPPEDSPARTTDHEVPTAAR

SEQ ID NO: 449 - DNA, 381 bp, Oryza sativa
atggcagcagctgcagcatcatccgtgtccctccccggggcgagggctctcccgacgtggtccagctccgtgtccggcgactcgcactcgttggcgctgagctcgtgggcggcgcggcctcggtcggcgcggccactgcgggcgccggcgaggatgggcaacgtgaacgagggcaaggggatcttcgcaccggtggtggtggtggtgcgcaacatcgttggccgcaagcgcttcaaccagctcaggggaaaggccatcgcgctgcactcgcagcaggtgatcaccgagttctgcaagaccatcggcgccgacgccaagcagaggcagggcttgatccgccttgccaagaagaacggcgagaagctcggtttccttgcctga

SEQ ID NO: 450 - protein, 126 aa, Oryza sativa
  misc_feature (49)..(49): Xaa = any naturally occuring amino acid
  misc_feature (55)..(55): Xaa = any naturally occuring amino acid
  misc_feature (93)..(93): Xaa = any naturally occuring amino acid
  misc_feature (111)..(111): Xaa = any naturally occuring amino acid
GSSCSIIRVPPRGEGSPDVVQLRVRRLALVGAELVGGAASVGAATAGAXRGWATXTRARGSSHRWWWWCATSLAASASTSSGERPSRCTRSRXSPSSARPSAPTPSRGRAXSALPRRTARSSVSLP

SEQ ID NO: 451 - DNA, 1362 bp, Oryza sativa
  misc_feature (225)..(225): y = cytosine or thymine
  misc_feature (227)..(227): s = guanine or cytosine
  misc_feature (230)..(230): m = adenine or cytosine
  misc_feature (265)..(265): s = guanine or cytosine
atggccgccgccgccgccgccgacgcatcggccgaggccgcggccatcgcgcggcgcctggcctcctgcaacggctccgcacgggagcgcgcggtgcggcacctcctctccaccttcctcccggcctcggctccgcacctctccgcctccgacctcctcaagctctggaagggcctcttcttctgcttctggcactccgacaagccgctctaccagtcctccctygscamccgccttgccgccggcgtctcctcgggccccttgscggccgccgccgccgccttcttcgccgcctacctcgccaccctccgccgcgagtgggtccacatcgacacccaccgcctcgacaagttctacctcctaaaccgcaggttcctccaccaagccttcctcctcctcgccgccaactccttcgccgccgacctcacctcccaggtcgtatcgatcctgtcggagaaggtactccttcccgaggccgacaacgtcgccgccggctcgccccgtgggcttgggtaccatgtcgccgaggtgtttctggacgagctgtcgcctgtgctccctgtgagcttacagacaatggaggtgttgctatctcctttcttcgctgtgttggagaagtcatctgatagggtgatggtggctaaggttaagtctagtgtgtttgagaggttcctcgagagcggcaaacaattgctcgagatggcgaagaaaggcgagggggtggagaaggggagcgcagacgagaagattgggaaggttggcttgctgtttgggttcagcaagaggttctcagatattggggcgaaggcggagaccgtgcaagcaaaccgaaaggtgctatttgggctgagggatgcgtttgtgaaggttgagaaaggattggagctctctggggtcgagattgctgtgccagagttcaagagtaccgaggtgacaggggtggagaatggcatggatttggatgaggtgaaggtggagaagaagaagaagaaaaaggcgaagaaagcttcattggtggaaggtgagacagagggggccaaggattcaaagcaagagaaaaaggtcaagaaggagaagaaagagaagaagaaaaagaagaaggtagaggttgttgatgagggagatgtcacggaacagagtacagacgctcctgcagaggaggaccaacagatgggtgatggtactgaggctgttacatttgatgagacattgatgtccaatctccagaagcagtttgagaaggctgcagcagaagctgtgcttgaggctgccaccatctgctactccaagagggagtgcactaaaaaagggtgttctgcctgggcctataaaagaaacgcctacgcctgtgaagaagactaa

SEQ ID NO: 452 - protein, 449 aa, Oryza sativa
MAAAAAADASAEAAAIARRLASCNGSARERAVRHLLSTFLPASAPHLSASDLLKLWKGLFFCFWHSDKPLYQSSRLAAGVSSGPLAAAAAFFAAYLATLRREWVHIDTHRLDKFYLLNRRFLHQAFLLLAANSFAADLTSQVVSILSEKVLLPEADNVAAGSPRGLGYHVAEVFLDELSPVLPVSLQTMEVLLSPFFAVLEKSSDRVMVAKVKSSVFERFLESGKQLLEMAKKGEGVEKGSADEKIGKVGLLFGFSKRFSDIGAKAETVQANRKVLFGLRDAFVKVEKGLELSGVEIAVPEFKSTEVTGVENGMDLDEVKVEKKKKKKAKKASLVEGETEGAKDSKQEKKVKKEKKEKKKKKKVEVVDEGDVTEQSTDAPAEEDQQMGDGTEAVTFDETLMSNLQKQFEKAAAEAVLEAATICYSKRECTKKGCSAWAYKRNAYACEED

SEQ ID NO: 453 - DNA, 779 bp, Oryza sativa
atggggagggaggagaggttcccggtgtgggaggcggcactgctcgccggcgtcgcggccgcctttgccacgggtctcgtcggcgtctacctctccatgcctcattcggactacagcttcctcaagctgcccaagaacctccaggagctccaaatcctcacatttgcagggatcatctcgaggactacacgagcgactacaccgtgcaggtgctggtgggctattgtgccgtgtacatcttcatgcagacgttcatgatcccaggaaccatattcatgtccctccttgccggagcactctttggccagcttggtggtgttgcccttgtggtctttgccgccacggctggagcttcttcatgctacttcctgtctaagctgattgggaaaccgttggtcttctcattgtggccggacaaacttgggttctttcagaagcagcaggttgcaaaaaggagagagaagctgttgaattacatgcttttccttagagtaactccaacattgcccaatactttcatcaatttagcgtcgccgatagtggatgtgccctaccatattttcttcctggcaacctttattggactaatcccagctgcctatgtgactgtcagggctggaatagctttgggagacttgagctcattgagtgacctatatgataaacaatcaatagcactgttgttcttgattggggttgtttcggtgacaccgacattgttgggcaagaacgagaagcaacaaggcaaagggccagaaatggtagctagcagtagctga

SEQ ID NO: 454 - protein, 258 aa, Oryza sativa
MGREERFPVWEAALLAGVAAAFATGLVGVYLSMPHSDYSFLKLPKNLQELQILICRDHLEDYTSDYTVQVLVGYCAVYIFMQTFMIPGTIFMSLLAGALFGQLGGVALVVFAATAGASSCYFLSKLIGKPLVFSLWPDKLGFFQKQQVAKRREKLLNYMLFLRVTPTLPNTFINLASPIVDVPYHIFFLATFIGLIPAAYVTVRAGIALGDLSSLSDLYDKQSIALLFLIGVVSVTPTLLGKNEKQQGKGPEMVASSS

SEQ ID NO: 455 - DNA, 351 bp, Oryza sativa
atggttcggctggaccctcgttcggtcaaacgagtagctggcccaatcagccgagtttttcaccagctggtagttacgagtgtcccaaggcgcttatggccggttctacctgaagaaaccgtcactggacacttggcagaaggagataatactctatatccaagctcacgacatagagtaacagaatactcggacattaaacccacaccattgcacctctctgaaatgccccgcaaccgtcattggggaggtatcctggacgtccacgtagagggtcgagttgtcatttcggtggttcctgtgatgcagtttgagttcgtcgctaaagcttcaaaagaccccttttcctga

SEQ ID NO: 456 - protein, 116 aa, Oryza sativa
MVRLDPRSVKRVAGPISRVFHQLVVTSVPRRLWPVLPEETVTGHLAEGDNTLYPSSRHRVTEYSDIKPTPLHLSEMPRNRHWGGILDVHVEGRVVISVVPVMQFEFVAKASKDPFS

SEQ ID NO: 457 - DNA, 1686 bp, Oryza sativa
  misc_feature (397)..(397): s = guanine or cytosine
  misc_feature (400)..(400): s = guanine or cytosine
  misc_feature (404)..(404): k = guanine or thymine
  misc_feature (407)..(407): r = adenine or guanine
  misc_feature (409)..(409): n = any nucleotide
  misc_feature (420)..(420): w = adenine or thymine
  misc_feature (439)..(439): s = guanine or cytosine
atggcccacgtcatggccgcctccgagctcgtcaccgccaccatcaagcgccccttccagaacgacgacgacaacagcagcaacggcaacggcaacgccgacgggaagcccaaggcgcggcgccgggaggccgacccggcggcggcgctggcgcgcggcgcgccacgagttcggcgagcacggcggggtgaacatgtccatcgaggcgtcggcgacgttcacggtgatggagccggacaccatgcgccgcctcttctccggggagctcggcccggagcgcggcgacctgtacatctacagccgccacttcaacccgacggtgctggcgctggggcggcagatggcggcgctggagggcaccgaggccgcgtactgcacggcgtccgggatgtccgcsatstcckccrtntcctccgtgcwgatgcagctcgtcggcgcsggggggcacgtggtggcgtcgcggtgcctgtacggcggcacgcacgcgctgctgtcccggttcctgccgcgcgcgtccggggtgcgcgcaacgttcgtggacgctgacgacgaggcggcggtgcgcgccgcggtgcgcccgggggagacgcgggtggtgtacgtggagacgatgtcgaacccgacgctggccgtggccgacatcccgatgctggcccgcgtcgcgcacgacgccggcgccaagctggtggtggacaacacgttcacgcccatggtcgtctcgccggcccgcctcggcgccgacgtcgtcgtccacagcgtctccaagttcatcagcggcggcgccgacatcatcgcagcaggggcgatctgtgggccggcgagcctggtgaacgcgatgatggacctgcaggagggggccctgatgctgctgggcccgacgatgaacgccaaggtggccttcgagctctcggagcgcctcccgcacctcccgctccggatgcaggagcactcgcggcgcgccgccgagtacgcgtcccggatgcgccgcctcggcctccgcgtcgcctacccgggcctccccgaccacccgcaccacgcccgcctcctcgccatcgccaacccgggctacggcgccggcggcatgctctgcgtcgacatgggcaccgaggaccgcgccaaccgcctcatgcaccacctccagaacaccacccgcttcggcctcatggccgtcagcctcggctactacgagaccctcatgtcgtgctccggcagcagcaccagcagcgagatgccgcccgaggaccgcgctcgcgccggcatctcccccggcctcgtccgcatgtccgtcgggtacaacggcacgctcgagcagcggtgggcgcagttcgagcgcgcgctctcgctcatgcagcagcagcagcagcagcatcccgaccgcgacgccgccgccaagtactgcaaggtgtgacgtcacgagccccgccattgatggtgcgcattagcgacgatccgatttgttgtatctgccccgtgttgctggtttgtatatatagtttattatgtaattactagtgctacctataagtaaggtttaagctgttaaactgagtactatctgatcgctctggttcagatagttgaatggcacagctaagctgcttgttctctgggaaactgagtgtattggaataagctggtgaaatgttatatggacaatgtttctgcagcaaccttctttctcagtaa

SEQ ID NO: 458 - protein, 468 aa, Oryza sativa
  misc_feature (133)..(133): Xaa = any naturally occuring amino acid
  misc_feature (135)..(136): Xaa = any naturally occuring amino acid
  misc_feature (140)..(140): Xaa = any naturally occuring amino acid
WPTSWPPPSSSPPPSSAPSRTTTTTAATATATPTGSPRRGAGRPTRRRRWRAARHEFGEHGGVNMSIEASATFTVMEPDTMRRLFSGELGPERGDLYIYSRHFNPTVLALGRQMAALEGTEAAYCTASGMSAXSXXSSVXMQLVGAGGHVVASRCLYGGTHALLSRFLPRASGVRATFVDADDEAAVRAAVRPGETRVVYVETMSNPTLAVADIPMLARVAHDAGAKLVVDNTFTPMVVSPARLGADVVVHSVSKFISGGADIIAAGAICGPASLVNAMMDLQEGALMLLGPTMNAKVAFELSERLPHLPLRMQEHSRRAAEYASRMRRLGLRVAYPGLPDHPHHARLLAIANPGYGAGGMLCVDMGTEDRANRLMHHLQNTTRFGLMAVSLGYYETLMSCSGSSTSSEMPPEDRARAGISPGLVRMSVGYNGTLEQRWAQFERALSLMQQQQQQHPDRDAAAKYCKV

SEQ ID NO: 459 - DNA, 965 bp, Oryza sativa
atgctactgctcacctttgaagcacaagcacaagcacaagcagctctagctagctacaggcatcagtggtcagtagagtgatcagttgcaactagctagctagttagattatatcttcagtgatggctccggcctgcgtctccgacgagcacgccgtcgcggtgtcggcggagcggctgtggaaggcgttcatggacgcgtccactttgcccaaggcctgcgccggcttggtcgacgacattgcggtcgaggggaacggtggtccgggcaccatctacaccatgaagcttaaccctggccgcgggtgtgggaagcacatacaagacccgggtggcggtgtgcgacgccgcaagtcatgtcctaaagtcggatgtgctcgaggcagaaagcaaggtggggaagctcaagtcacactcgacggagacgaagcttgaggccaccggcgatggctcctgtgtggccaagctcaaggtggagtacgagctcgaggacggcagctcactgtcgccggagaaggagaaggacatcgtggatggctactatggcatgctcaagatgatcgaggactacctcgtcgctcaccctgccgaatacgcctaagatgaagaggaatactgcctctatccagtatatcccacctagagtgagtgataattaaataatgagagccgcagaaatgtccaaattctcgtggcgtttgagtccgtgagagtaatttcgtgctttaagtttgtggttgtgtttatgtgcctttctatggtcgtattcagtgttaaagttatcattttgcttcatcaatgggtgaataaagagaggcaagtctgaatgtgttctgctatggtttggaggtgtttatgagcctttctatgggcgtgttcagtgtttaaaagttatcattttgcttcatgaatggatgaataaagagaggcaagtctgaatgtgttctgctatagtttggaggttaa

SEQ ID NO: 460 - protein, 112 aa, Oryza sativa
  misc_feature (11)..(11): Xaa = any naturally occuring amino acid
  misc_feature (17)..(17): Xaa = any naturally occuring amino acid
  misc_feature (21)..(21): Xaa = any naturally occuring amino acid
  misc_feature (30)..(31): Xaa = any naturally occuring amino acid
  misc_feature (92)..(92): Xaa = any naturally occuring amino acid
STSTSTSSSSXAYSAGXATRXSSIILSMPXXPSTMSFSFSGDSELPSSSSYSTLSLATQEPSPVASSFVSVECDLSFPTLLSASSTSDFRTXLAASHTATRVLYVLPTPAAR

SEQ ID NO: 461 - DNA, 495 bp, Oryza sativa
atggaggtatccaagctggccattgctttggccatggtagccgccatggcactcccctcccaagctcaaaactccccgcaggactacgtgaggctccacaacgccgcccgcgccgccgtcggcgtgggtccggtgacctgggacacgagcgtgcaggcgttcgcggagaactacgccagccagagaagcggcgactgcagcctgatccactccagcaaccggaacaaccttggcgagaacctcttctggggttcggccggcggggactggacggcggcgagcgcggtgcagtcgtgggtgggcgagaagagcgactacgactacgcctccaacagctgcgcgcaggggaaggtgtgcgggcactacacgcaggtggtgtggcgcgcgtcgaccagcatcggctgcgcccgcgtcgtctgcagcaacggccgcggcgtcttcatcacatgcaactataagccggccggcaacttcgtcggacagaggccttactaa

SEQ ID NO: 462 - protein, 164 aa, Oryza sativa
MEVSKLAIALAMVAAMALPSQAQNSPQDYVRLHNAARAAVGVGPVTWDTSVQAFAENYASQRSGDCSLIHSSNRNNLGENLFWGSAGGDWTAASAVQSWVGEKSDYDYASNSCAQGKVCGHYTQVVWRASTSIGCARVVCSNGRGVFITCNYKPAGNFVGQRPY

SEQ ID NO: 463 - DNA, 1137 bp, Oryza sativa
atgtcttcttcactccagtgccccgacgacccggcgccatccatgaacgtggaggccgtcctccacatgaaggaaggtgtcggcgagaccagttacgccaagaactctacgcttcagaagaagagcatggacaccgtgaagagcctcgtgacggagtccgcgagggacgtgtacgcgtcgctcaagccggaaaggttcaccctggccgacctcggctgctcgtcggggacgaacgctctcggcatggtggaggagatcgtcaggagcgtcgccgaggtgtgccgcgggtcgtcgccaccgccggagttctcggtgctcctcaacgacctccccaccaacgacttcaacaccatcttctcccgccttcccgagttcaccggcaagctcaaggccgacgccgacgccgacgccggcgacgacccgatggtgttcctgtccggcgtccccgggtccttctacgggaggctgttccccagcaagaatgtgcacttcgtctgctccttctccagcctgcactggctctctcaggttcctcccggtcttttggatgagacgaacgggcccgtgaacaaggggaagatgttcatatcgagcacgagccctccagccgtggcagcggcgtactcgaggcagttccggagagacttcagcctgttcctcaggtcacgcgccgccgaggtcgtcgccggcggccggatggtggtctccatgctcggcagggagggcgagcgccacgcggacaggaacacgaccctgctgtgggatctcctctccgagtcgttcgccgcgctggtgtcacagggggtggtggagcagggcaaggtggacgcgtacgacgcgccgttctacgcgccgtcgataggggagatcgaggaggaggtgcggcggcaggggtcgttcaggatggaggtcgcgcgggcgtacgaggcgagcctgagcggcagcggcgacgcgaggaaggacggaaggacggtgtcgatggcggtgagggccatccaggagtccatgctggggcaccacttcgggacggagatcgtcgacgcgctcttcgccaagtacaccgagctcgtcacggcgaccatggagagggaggaggtcaggagcgtccagattggagtggtcctcacgaggctgtga

SEQ ID NO: 464 - protein, 378 aa, Oryza sativa
MSSSLQCPDDPAPSMNVEAVLHMKEGVGETSYAKNSTLQKKSMDTVKSLVTESARDVYASLKPERFTLADLGCSSGTNALGMVEEIVRSVAEVCRGSSPPPEFSVLLNDLPTNDFNTIFSRLPEFTGKLKADADADAGDDPMVFLSGVPGSFYGRLFPSKNVHFVCSFSSLHWLSQVPPGLLDETNGPVNKGKMFISSTSPPAVAAAYSRQFRRDFSLFLRSRAAEVVAGGRMVVSMLGREGERHADRNTTLLWDLLSESFAALVSQGVVEQGKVDAYDAPFYAPSIGEIEEEVRRQGSFRMEVARAYEASLSGSGDARKDGRTVSMAVRAIQESMLGHHFGTEIVDALFAKYTELVTATMEREEVRSVQIGVVLTRL

SEQ ID NO: 465 - DNA, 446 bp, Oryza sativa
atggcggtgccgctgctgacgaagaagatcgtgaagaagagggtcaagcagttcaagaggccccatagtgaccgctacctatgcctcaagagctggcgcaggcccaagggtattgactcccgtgtcaggagaaagttcaagggatgcaccttgatgcccaacattggttacggctcagacaagaagaccaggcactacctccccaacaagttcaagaagtttgtggtgcacaatgtctctgagctggagttgctcatgatgcacaacagaacaggacctactgtgccgagattgcccacaacgtctctacgaagaagcgcaaggagatcgttgagcgtgctgcgcagctcgacatcgtggtcaccaacaagcttgcaaggctccgtagccaggaggacgagtaggctgttttatcagtataatgttttggtctggtttgattgtag

SEQ ID NO: 466 - protein, 135 aa, Oryza sativa
  misc_feature (31)..(31): Xaa = any naturally occuring amino acid
  misc_feature (91)..(91): Xaa = any naturally occuring amino acid
MAVPLLTKKIVKKRVKQFKRPHSDRYLCLKXSWRRPKGIDSRVRRKFKGCTLMPNIGYGSDKKTRHYLPNKFKKFVVHNVSELELLMMHNXNRTYCAEIAHNVSTKKRKEIVERAAQLDIVVTNKLARLRSQEDE

SEQ ID NO: 467 - DNA, 423 bp, Oryza sativa
atggaccacttgaactggaggagcatgagtatccccagtgcagctcctgtggtacatgccactggctgtcgctggcactctgccaggatgaacctccagcgtcatgttgtggaacttgggtctaacctggggcatccgcagtcgggtcccaactgccttcatacatctgcactggtggtgaagaggaagacgcctcttgagaataaccggaaagtacaccatcgcctactgcatgaaggtcgagttgtatgctcaggtcagagcacacgttcggtctttcagcatatgataggcttgcattttccggttgcccatgaggttgagatcggagttgtcgtacagcctcggtggaacgtacgcctcctccatggattcatccgcggaagaaggtgtactcagcttattgtgtcggcttgtccgtga

SEQ ID NO: 468 - protein, 140 aa, Oryza sativa
MDHLNWRSMSIPSAAPVVHATGCRWHSARMNLQRHVVELGSNLGHPQSGPNCLHTSALVVKRKTPLENNRKVHHRLLHEGRVVCSGQSTRSVFQHMIGLHFPVAHEVEIGVVVQPRWNVRLLHGFIRGRRCTQLIVSACP

SEQ ID NO: 469 - DNA, 1012 bp, Oryza sativa
  misc_feature (887)..(887): r = adenine or guanine
  misc_feature (1004)..(1004): y = cytosine or thymine
atgggcaaccccctcctcgacatctccgccgtcgtcgacgacgccttcctcaccaagtatgacgtcaagctgaacaatgcaattctcgctgaggaaaagcacttgcctatgtatgatgagttggccagcaagggcaatgttgaatatattgccggagaggagccacccagaactctatcagggttgctcaacagtggatgcttcaaactcctggtgcaacaagttacatgggttgcattggaaaggataagtttggtgaggagatgaagaagaatgcccaagctgctggtgttactgctcattactacgaggatgaggctgctcccacgggcacatgtgctgtctgtgttgttggtggtgaaagagatcactggttgcaaacttatcagcagcaaactgctacaaatctgagcatctgaagaaaccggagaactgggcactaggtggagaaagcaaaatacatctacattgctggctttttccttacggtctccccagattctattcagcttgttgctgagcatgctgccgctaacaacaagaggtgttcctgatgaacctctctgcaccctttatctgtgagtttttccgtgatgcccaggagaaggttcttccgactacatcttcggtaacgaaacagaagcaagaatctttgctaaagtccgtggatgggagagactgagaatgttgaggagatcgcgttgaagatttcccagcttccattggcctctggaaaacaaaagaggattgccgtgattactcaaggtgctgatccagtagttgtcgctgaggatggacagaggtgaaaacattccctgtgatcctactgccaaaggagaagcttgttgacaccaatggcgctgcttcctctcacaattggtcaacaraagagtcattgaggactctgtgagctggttgctatgccgcaaatgttatcatccagcagtatctggctgcacttaccctgagaagcctgatttcaactagggctaactcacacacayatagttga

SEQ ID NO: 470 - protein, 333 aa, Oryza sativa
  misc_feature (53)..(53): Xaa = any naturally occuring amino acid
  misc_feature (122)..(122): Xaa = any naturally occuring amino acid
  misc_feature (139)..(139): Xaa = any naturally occuring amino acid
  misc_feature (183)..(183): Xaa = any naturally occuring amino acid
  misc_feature (208)..(210): Xaa = any naturally occuring amino acid
  misc_feature (229)..(229): Xaa = any naturally occuring amino acid
  misc_feature (301)..(301): Xaa = any naturally occuring amino acid
MGNPLLDISAVVDDAFLTKYDVKLNNAILAEEKHLPMYDELASKGNVEYIAGXGATQNSIRVAQQWMLQTPGATSYMGCIGKDKFGEEMKKNAQAAGVTAHYYEDEAAPTGTCAVCVVGGEXRSLVANLSAANCYKSEXHLKKPENWALVEKAKYIYIAGFFLTVSPDSIQLVAEHAAANNKXVFLMNLSAPFICEFFRDAQEKVLPXXXYIFGNETEARIFAKVRGWXETENVEEIALKISQLPLASGKQKRIAVITQGADPVVVAEDGTEVKTFPVILLPKEKLVDTNGAAFLSQLVNXRVIEDSVSWLLCRKCYHPAVSGCTYPEKPDFN

SEQ ID NO: 471 - DNA, 1075 bp, Oryza sativa
atggcttcctccgacgccgcggccgcgcaggcggcgacgccgctgctgaaggacgagctggacatcgtgatcccgacgatccgcaacctggacttcctggagatgtggaggcccttcttccagccgtaccacctcatcatcgtccaggacggcgaccccaagaagacgatccgggtgcccgagggcttcgactacgagctctacaaccgcgacgacatcaaccggatcctcggccccagggcctcctgcatctccttcaaggactccgcctgccgctgcttcggctacatggtctccaagaagaagttgctaaagacccatcaggaaaggatatcaatgcacttgagcagcacatcaagaaccttctgaacccttccactccatttttcttcaacactttgtatgacccgtaccgtgatggcgctgattttgtccgtgggtaccccttcagcctccgtgagggtgccccgactgccgtttctcatgggctttggctcaacattccagactatgatgcccctacccagcttgtcaagcctcttgagaggaacagcagatcaggtatgtggatgctgttatgacaatcccgaagggcactttattcccgatgtgtggaatgaaccttgcttttgaccgtgacctcatcggtcctgcgatgtactttggtcttatgggtgatggccagcctattggtcgttacgacgatatgtgggcaggatggtgcaccaaggtgattaccgatcacttgggtttgggtgttaagactggccttccctacatctggcacagcaaagcgagcaacccctttgtgaacctcaagaaggaatacaacggcatattctggcaggaggagctgatccccttcttccagtctgcgtccctcccgaaggaggccgacactgtccagaagtgttaccttgagctggccaagcaagtgagggcgaagctcgggaaggtcgatggctacttcaacaagctcgccgactccatggtcacatggattgaggcctgggatcagctgaacccaccaaagggagctgttgccaccgcaaacggcactgccaagagcaagtga

SEQ ID NO: 472 - protein, 103 aa, Oryza sativa
  misc_feature (7)..(7): Xaa = any naturally occuring amino acid
RTSWTSXSRRSATWTSWRCGGPSSSRTTSSSSRTATPRRRSGCPRASTTSSTTATTSTGSSAPGPPASPSRTPPAAASATWSPSPSRTPPAAASATWSPRRSC

SEQ ID NO: 473 - DNA, 1230 bp, Oryza sativa
atgtttggtgttttcatttatgcagagacgaattaccaaaacaaattaatttcagtccactacaagagctttagtaataacatcgttagttattgtaatgcagctgttcctggtttacccattattggaaatctgcatcaattgaaagaaaagaagcctcatcagacgtttgcaaaatggtctgaaacttatggaccaatctacactataaagaccggagcttctccagtggttgtgctcaattcaactgaagtagccaaggagttctcatccatatctactcgaaagctaccaaaagcaatgtctgtgctaactcgtaaaagtatggtcgcaatcagcgactacggtgactaccaaaagatggcgaagcgtaatattatgattggcatgttaggttttaatgcacagcccacattcccctctgaacttcagggtgaggatgtgagttcagtttatgtggaagagtttgggagggagatatccaaggacgaaatctttgatgtccttgtgcatgagatgatgatgtgtgcagttgaggctgactggagggactacttcccctacctcagctggcttccaaacaagagcttcgacacaattgtgtctactacagaattcagacgagatgctatcatgaatgcattgatcaagaagcagaaggagaggattgcacgcggagaggctgatactgtcctggtgaccaccgaatggaccatgtatgagattgccaagaaccctgacaaacagtgcggcggcgaggcggtgaccgaggacgacttgccgcggctgccgtacctcaacgccgtgttccacgagacgctgcggctgcactccccggtgccggtgctgcccccgaggttcgtccacgacgacaccacgctcgccggctacgacatcgcggcgggcacccagatgatgatcaacgtgtacgcgtgccacatggacgagaaggtgtgggagtcgccgggggagtggtcgccggagaggttcctcggcgaggggttcgaggtggcggacaggtacaagacgatggcgttcggcgccgggaggaggacctgcgcggggagcctgcaggcgatgaacatcgcgtgcgtcgccgtggcgcgcctcgtgcaggagctcgagtggaggctgagggagggcgacggggacaaggaggacaccatgcagttcaccgccttgaagcttgacccgctgcatgtccacctcaagcccagaggaaggatgtga

SEQ ID NO: 474 - protein, 409 aa, Oryza sativa
MFGVFIYAETNYQNKLISVHYKSFSNNIVSYCNAAVPGLPIIGNLHQLKEKKPHQTFAKWSETYGPIYTIKTGASPVVVLNSTEVAKEFSSISTRKLPKAMSVLTRKSMVAISDYGDYQKMAKRNIMIGMLGFNAQPTFPSELQGEDVSSVYVEEFGREISKDEIFDVLVHEMMMCAVEADWRDYFPYLSWLPNKSFDTIVSTTEFRRDAIMNALIKKQKERIARGEADTVLVTTEWTMYEIAKNPDKQCGGEAVTEDDLPRLPYLNAVFHETLRLHSPVPVLPPRFVHDDTTLAGYDIAAGTQMMINVYACHMDEKVWESPGEWSPERFLGEGFEVADRYKTMAFGAGRRTCAGSLQAMNIACVAVARLVQELEWRLREGDGDKEDTMQFTALKLDPLHVHLKPRGRM

SEQ ID NO: 475 - DNA, 889 bp, Oryza sativa
atggcggccaggctgcggaggccggcggcggcgtcgttccgggaggggtacacgcagctgttcggcgactccaacctcgcgctccatggcgacggcaagcgggtccgcatctccctcgatgagcgcacagggcgccggattcgcgtcgcaggatgcgtatctgcatggcttcttcagcgccagcatcaagctgccgcccgattacgccgccggtgtcgtcgtcgccttctatatgtcgaatggcgatgtgtatgagaagacgcatgatgagctggactttgagttcctagggaacattaaggggagggagtggagagtgcagaccaacgtgtatggcaatggcagtacatcggtcggcagggaggagagacggaggatttccatcgttacgccattctttggagccatgactggatcgtgtaagccaatccgggaggttcagaggaccaaatccatgggagttcagttcccttccaaaccgatgtcgctgtacgccacaatctgggatggctccagctgggctacctccggtggccggtacaaggtgaactacaagtacgcccctttcgtcgcagagttttcggaactcatgctccatggctgcgctatggacaccttgacccgtgcaccgatgtgcacaccggacattgccaacatccacaatgccgtggccatgtctggtaggcagcgatcggcgatggagaggttcaggacgaagtacatgacttacggctactgctatgatcgtcttcggtatcctacacctccatcagagtgcaatgtcggccctgaggccgagctattcctccccacgggcgaggcgaggtccatcgaccgccatggacgagctaggcgccaccgtcgtggtccagctgattcagcattctga

SEQ ID NO: 476 - protein, 96 aa, Oryza sativa
  misc_feature (50)..(50): Xaa = any naturally occuring amino acid
  misc_feature (56)..(56): Xaa = any naturally occuring amino acid
WRPGCGGRRRRRSGRGTRSCSATPTSRSMATASGSASPSMSAQGAGFASXGCVSAXASSAPASSCRPITPPVSSSPSICRMAMCMRRRMMSWTLSS

SEQ ID NO: 477 - DNA, 711 bp, Oryza sativa
atgttggccatattccagaagcaggtggcgcacgcgccggcggagctgaacagcccgcggagcagcgcggcgaagcccaagaaccccgacgagatcctcagggacttccacgccctccaccccatcgaggccttctccacctccttcggcaggatgttctgtgggctggatgacatctactgcgtgttcatggggaggctggacaacctgagcagcctgatccggcagtacgggctgtgcagccgctccaccaacgaggcgctgctcgtcatcgaggcctaccgcaccctccgcgaccgcggcccctaccccgccgaccaggtcgtcaaggatctctccggctccttcgccttcgtcgtcttcgacaacaagtccggcgccgtcttcgccgccctggatggggaggtgccgttgtattgggggatcgcggcggatgggtcggtggtgatctgcgacgagagggagatcgtgaagggagggtgcggcaagtcgtacgcgccgttcccggtggggtgcatgttccacagcgagggggggctcaagagcttcgagcacccgatgaaccggctgaaggcgatgccgcgggtggacagcgagggcgtcatgtgcggcgccaccttcaaggtcgacaccttcaccaagatcaactccatgccccgcgtcggcagcgccaccaactgggccgccacctgggacgacgctgccgcctga

SEQ ID NO: 478 - protein, 236 aa, Oryza sativa
MLAIFQKQVAHAPAELNSPRSSAAKPKNPDEILRDFHALHPIEAFSTSFGRMFCGLDDIYCVFMGRLDNLSSLIRQYGLCSRSTNEALLVIEAYRTLRDRGPYPADQVVKDLSGSFAFVVFDNKSGAVFAALDGEVPLYWGIAADGSVVICDEREIVKGGCGKSYAPFPVGCMFHSEGGLKSFEHPMNRLKAMPRVDSEGVMCGATFKVDTFTKINSMPRVGSATNWAATWDDAAA

SEQ ID NO: 479 - DNA, 1073 bp, Oryza sativa
atgcctttctatttcaattcgttcttctcaccttattgtattttcttatttactcatgacatatcattcaatggtattttgttgtcacaggacgacatcataaaggcaatcaacaagcatcccaatgctggctggacggctgcacggaatccatactttgcaaactatactgcaattcaaacatatccttggagtgaagccaacaccgcatagtgtgctaaatgatgtccctgtcaaaacttatccaagatcgctgatgcttccaaaggagtttgatgccaggtctgcatggtcacagtgtaacacaattgggaccatacttgcagggtcactgtggctcgtgttgggcatttggtgctgtggagtgtctccaggatcgtttctgcattcatttcaacatgtcgctatctgtcaatgacctagtggcatgctgcggtttcatgtgcggcgatggttgtgatggaggctatcctatcatggcatggcgctactttgttcggaatggtgttgttaccgatgagagtgcgatccatactttgatcaggtcggttgtaagcatccaggatgcgaacctgcttatcctacgccagtgtgcgagaagaaatgcaaggtgcagaaccaagtttggctggaaaagaagcatttcagtgtcaatgcatacagagtaaattctgatccacatgacataatggcagaggtctaccaaaatggccctgtagaagttgctttcaccgtttatgaggattttgcacactacaaatcaggagtatacaagcacatcacaggtggcatgatgggtggtcatgctgtcaagttgattggatggggaaccacggatgctggcgaggattactggctgcttgcaaaccagtggaacagaggatggggcgatggatgggtacttcaagatcataaggggcacaaacgaatgtggcatcgaagaagatgttgttgctggtatgccctcgacgaagaacatggtgaggaactatgatagcgccttcggagtcggaacggccatagtttgactttaatcaatgttaatggcctcaaatacggttgggatcatgtaa

SEQ ID NO: 480 - protein, 341 aa, Oryza sativa
MPFYFNSFFSPYCIFLFTHDISFNGILLSQDDIIKAINKHPNAGWTAARNPYFANYTQFKHILGVKPTPHSVLNDVPVKTYPRSLMLPKEFDARSAWSQCNTIGTILQGHCGSCWAFGAVECLQDRFCIHFNMSLSVNDLVACCGFMCGDGCDGGYPIMAWRYFVRNGVVTDESCDPYFDQVGCKHPGCEPAYPTPVCEKKCKVQNQVWLEKKHFSVNAYRVNSDPHDIMAEVYQNGPVEVAFTVYEDFAHYKSGVYKHITGGMMGGHAVKLIGWGTTDAGEDYWLLANQWNRGWGDDGYFKIIRGTNECGIEEDVVAGMPSTKNMVRNYDSAFGVGTAIV

SEQ ID NO: 481 - DNA, 951 bp, Oryza sativa
  misc_feature (267)..(267): y = cytosine or thymine
  misc_feature (269)..(269): m = adenine or cytosine
  misc_feature (334)..(334): m = adenine or cytosine
  misc_feature (336)..(336): y = cytosine or thymine
atggagcacgagcagctagtgcaagccagcacggagctgatgcaccacagcctgggctacgtcaggtccatggccctcgggtgcgccgccaagctcggcgtcgccgacgccatccaccgcgccggcggccgcgccaccctccacgacctgcacgccgcgctgtccctccacccgaccaagctccccttcctgcgccgcgtcatgcgcgtgctggtcgcctcgggcgtcttcgcgcaggtcaaggaggaggaggaccactaccgcctyamgcccgtgtcgtccctgctcgttaaccgccggcaggacgcttctgccgttcgtgctcctccagcamtygccgcttctgcgcgcgccccggagctcggcgatttcttcaacgatgccatggcggccgactcggcgttcatcatggacgcggccatccgtggcgcacgccaggtgttcgacaagatcacctcccttgtggatgtcgcaggcggcactggcgcggcggcgagggcggtggctgctgcgttcccgcatatcaagtgcacggtgctggaccttcctcacgtgatcgattccattcctgttgatcatggcgacgttgttcagtttgtcgcaggcgatatgatggattttatcccccaagcagatgccctcctgcttaagtttgtcctacacgactggagtgatgaggactgcgtaaagatattaaaacgatgcaaggaggcaattccttctaaagataaaggagggaaagtcattatcattgatgttgtggttggatcctcctcccaagcaatgtgctatggaacccaactgctgtttgatctaaccatttctatgctaacaccaggcatggagagggatgagaaagagtggttcaagatattcaacgaggccgggttcactgagtacaagattagtcctgtgttaggcattcgatccattatcgaggtctttccataa

SEQ ID NO: 482 - protein, 316 aa, Oryza sativa
MEHEQLVQASTELMHHSLGYVRSMALGCAAKLGVADAIHRAGGRATLHDLHAALSLHPTKLPFLRRVMRVLVASGVFAQVKEEEDHYRLKPVSSLLVNRRQDASAVRAPPAIAASARAPELGDFFNDAMAADSAFIMDAAIRGARQVFDKITSLVDVAGGTGAAARAVAAAFPHIKCTVLDLPHVIDSIPVDHGDVVQFVAGDMMDFIPQADALLLKFVLHDWSDEDCVKILKRCKEAIPSKDKGGKVIIIDVVVGSSSQAMCYGTQLLFDLTISMLTPGMERDEKEWFKIFNEAGFTEYKISPVLGIRSIIEVFP

SEQ ID NO: 483 - DNA, 1318 bp, Oryza sativa
atggcggccgcgaagcacttcacctacgtcatcctcggcggaggcgtcgccgcggggatacgctgcgcgggagttcgccaagcagggcgtcaagcccggggaactcgccatcatctccaaggaatcgggtggctccctacgagcgtcctgctctcagcaagggatacctctttcctcagaatgcagccagacttccgggattccacacctgcgtcgggagcggcggagagaggctcttgcctgaatggtattccgagaaagaggtatcgagctgatcctgagcaccgaaattgtcaaggctgatcttgcctccaagacattgaccagttcagctgatgcaacctttacctatgacactttgctcattgccactggctcctcgggtcataaagctcactgactttggtgttcaaggagcagaggccaacgacatattgtacctgagggatattgaggacgctgacaagttggtcgcggctatgcaagccaagaaggatggaaaggctgtgattgtcggaggtggctacataggacttgagcttagcgcagccttgaagaccaacaattttgatgtcactatggtgtaccctgaaccttggtgcatgccccgtctcttcacttctggccttgctgctttctacgagggatactacgctaacaaaggaatccatatcataaagggaaccgtggctgttggttttgatgctgatgccaatggagatgttactgcggtgaagctaaagaatggaaacgtgctggaagctgacattgttattgtcggtgtcggtggcaggccactgactcatctcttcaagggtcaagttgcagaggagaagggtggaatcaagagactgatgcattcttcgaaacgagcgttcctggtgtatacgccattgccgacgtggccgccttcccgatgaagctatacaatgagattaggagagtagagcatgttgaccatgctcgcaaatcagccgagcaggccgtgaagcaggcgatcaaggcgaaggaggccggcgagtcggtgccggagtacgactacctgccctacttctactcccggtcgttcgacctctcgtggcagttctacggcgacaacgtcggcgaggatgtgctgttcggcgacaacgaccccacggcggccaagcccaagttcggctcgtactggatcaaggacggcaaggtcgtcggcgtcttcctcgagggcggctcggcggaggagaatcaggtcattgccaaggtcgccagagctcagccgccggtggccgacgtcgaggctctcaagaaggaaggactcgacttcgctgccaaagtctga

SEQ ID NO: 484 - protein, 439 aa, Oryza sativa
  misc_feature (241)..(241): Xaa = any naturally occuring amino acid
MAAAKHFTYVILGGGVAAGYAAREFAKQGVKPGELAIISKESVAPYERPALSKGYLFPQNAARLPGFHTCVGSGGERLLPEWYSEKEGIELILSTEIVKADLASKTLTSSADATFTYDTLLIATGSSGIKLTDFGVQGAEANDILYLRDIEDADKLVAAMQAKKDGKAVIVGGGYIGLELSAALKTNNFDVTMVYPEPWCMPRLFTSGLAAFYEGYYANKGIHIIKGTVAVGFDADANGDXVTAVKLKNGNVLEADIVIVGVGGRPLTHLFKGQVAEEKGGIKRLMHSFETSVPGVYAIADVAAFPMKLYNEIRRVEHVDHARKSAEQAVKQAIKAKEAGESVPEYDYLPYFYSRSFDLSWQFYGDNVGEDVLFGDNDPTAAKPKFGSYWIKDGKVVGVFLEGGSAEENQVIAKVARAQPPVADVEALKKEGLDFAAKV

SEQ ID NO: 485 - DNA, 963 bp, Oryza sativa
atggtaagctcccgtctccggtgccagttgccccccgcggttctcttcccgtggatcttgcgatccgccggcttagattttttttttcttcagttgcagcgtcgatttgtagctttgtattttgtgtgtgaatattgggatgctctaagtaagattttggatggcgaatcttgcaggcaccgaagcgaggcggcagggcgccggtgccggcgaagaagaagacggagaaggtgaccaacccgctgttcgagaagaggccgaagcagttcggcatcggcggcgcgctgccacccaagaaggatctgcacaggttcgtgaagtggcccaaggtggtgcgcatccagcgccagcgccgcatcctcaagcagcgcctcaaggttcccccggcgctcaaccagttcacccgcaccctcgacaagaacctcggcaaccaacctgtttaagatgcttctcaagtaccgccctgaggacaaggctgccaagaaggagaggcttttgaagagggcccaggctgaggctgaagggaaaaccgttgaggccaagaagccaattgttgtgaagtatggtcttaaccacgtgacttacctcattgagcagcagagcaaggcccagctggttgtcatcgctcatgatgttgatccaattgagctggttgtgtggcttccagccctgtgtaggaagatggaggtcccttactgcatcgttaagggcaaagctcgccttggatcgattgttcacaagaagactgcatctgttctgtgcttgaccactgtcaagaacgaggacaagcttgagttcagcaagatcttggaggccatcaagactttgtaggcgaacttcaacgacaagttcgacgaggtcaggaagaagtggggaggcggcgtcatgggctccaagtcgcaggcgaagaccaaggccagggaaaagcttctcgctaaggaggccgcccagcggatgacctaa

SEQ ID NO: 486 - protein, 320 aa, Oryza sativa
MVSSRLRCQLPPAVLFPWILRSAGLDFFFLQLQRRFVALYFVCEYWDALSDFGWRILQAPKRGGRAPVPAKKKTEKVTNPLFEKRPKQFGIGGALPPKKDLHRFVKWPKVVRIQRQRRILKQRLKVPPALNQFTRTLDKNLGATNLFKMLLKYRPEDKAAKKERLLKRAQAEAEGKTVEAKKPIVVKYGLNHVTYLIEQQSKAQLVVIAHDVDPIELVVWLPALCRKMEVPYCIVKGKARLGSIVHKKTASVLCLTTVKNEDKLEFSKILEAIKTLGANFNDKFDEVRKKWGGGVMGSKSQAKTKAREKLLAKEAAQRMT

SEQ ID NO: 487 - DNA, 500 bp, Oryza sativa
  misc_feature (478)..(478): m = adenine or cytosine
atggaccatctgacaaaggagcagatcgctgagttccgggaggcattcaacctgttcgacaaagatggagacggggacgatcacgagcaaggagctagggacggtgatggggtcgctggggcagtcgccgacggaggcggagctgaagaagatggtggaggaggtggacgcggatggcagcggcagcatcgagttcgaggagttcctgggcctcctcgcccgcaagctccgcgacacccgcgaggccttccgcgtcttcgacaaggaccagaacggcttcatcacccccgacgagctccgccacgtcatggccaacctcggcgaccccctctccgacgacgagctcgccgacatgctccacgaggccgactccgacggcgacggccagatcaactacaacgagttcctcaggtcatgatggcaaagtcagtctctctcttctttcttcctcccatttcatttctttctgctttcttcmattctttcttttctccatgtag

SEQ ID NO: 488 - protein, 148 aa, Oryza sativa
  misc_feature (80)..(85): Xaa = any naturally occuring amino acid
MDHLTKEQIAEFREAFNLFDKDGDGTITSKELGTVMGSLGQSPTEAELKKMVEEVDADGSGSIEFEEFLGLLARKLRDTXXXXXXREAFRVFDKDQNGFITPDELRHVMANLGDPLSDDELADMLHEADSDGDGQINYNEFLRVMMAK

SEQ ID NO: 489 - DNA, 762 bp, Oryza sativa
atggcggaggacagaggaagagagcaccgccgctacttgcatcacagcgttgtcgttttcatcacagccgctgtcatcgccgtcgtcgtcgtcgcagctaccatcgccgctgtcgtcgtcgttgcagccaccgtcaccgtcgttgcgaatctgcgtgctgccggcactcccgctcacgccagggcgctcccgaggacggaggccgctggattcatgcgccgccgtcgctcccgaggccgggaggcggcagatccgcgcgccaccgtcccttccctggctgggggagcgaggcggggaagggcgacgaggtggctgggggcggaaatggaggtggcgcggtggatggaggaggtggtgccggatccgctcgtcgccgtccaccgcgcgccgtcgatgtcgacgaggccctccgtcgtcacggtcgtcgtccaaagtcgccaaggcccctcccatgtcgctgtcgtcgtcgtcgccgctgagccgccgggagggaggagccgagctcccgccgtccttacttgtcgccgagccgccgccgggattgaaggggagaagaggggagggaggaaccaagctcccgccgcccttccttgtcgcggagccgccgccgccgctgccaccgggattggaggggagaagaggcgagggaggagccgagctctcgccgcccctactctcgtcaccgagccaccgccggattggacgggagaagcgggggagattggagagggagaggataaggtttcgttggtcactggttga

SEQ ID NO: 490 - protein, 253 aa, Oryza sativa
MAEDRGREHRRYLHHSVVVFITAAVIAVVVVAATIAAVVVVAATVTVVANLRAAGTPAHARALPRTEAAGFMRRRRSRGREAADPRATVPSLAGGARRGRATRWLGAEMEVARWMEEVVPDPLVAVHRAPSMSTRPSVVTVVVQSRQGPSHVAVVVVAAEPPGGRSRAPAVLTCRRAAAGIEGEKRGGRNQAPAALPCRGAAAAAATGIGGEKRRGRSRALAAPTLVTEPPPDWTGEAGEIGEGEDKVSLVTG

SEQ ID NO: 491 - DNA, 1254 bp, Oryza sativa
  misc_feature (172)..(172): m = adenine or cytosine
atggccccgccctccgactccgacgactcggccccgatccccgccggcgccatctccaagctcctcatcgtcatagcgatgcagacggaggcgctcccgctcgtcaacaagttccacctcgtcgaggcggaggaatccatctctgaagctaactcctacctttgtggcacamgcctaacagatttcctaaaggtgccccatggattagataccatggcaactacaaaggccttcacgttgaccttgtatggcctggaaaagatcctgttctcgtcattgaagccagatctgatcatcaatgctggcactgctggtgggtttaaggccaaaggagcagacattggagatgtctacttagcatccgatgttgcattccacgataggagaatacctatccctgtcttcgacatgtatggaattggaacacgaaaaacatttgctacccctaatatattgaaggaactcaatttgaaggttgggaagctctcaactggcgattctctagatatgtctccccatgacgagtcagcaatattgaacaatgatgctacagtcaaggatatggagggagccgcggtggcatatgttgctgacatgttttcaacaccggcaatctttgtgaaagctgtgactgatattgttgatggggagaaaccaacagccgaggagtttctgcagaacctggttgctgtgacagcagctctggacaaggcagttacagaagtgatggagctggacactgatcctaccaagctgaaggccaagcccatcatcaaaccaaaagtagaaccctgcgacgacgatgacgagttgccgccgccgccgccgccggcttcaggatccggcgaggattgggaggccaccacccctctcgccgccggcaaccccttcttcaccgccctcatcgccaagtctcatctccaccccaagttccagatgtggattccacctcggttccagcatcggctggcggagccggaggcgcgcacggcggcggtgctccactccggcggcaagtcgtgggcgacgagctactgcggccacctcaagatgaagaagctggacgcgggatggtcggagttcgcggtggacaaccggctcctggtcggggacgcctgcgtcttcgagctcgtcgccatgggcgccgccggaggtctggagttccaggtgcagatactccgcggcggcctgccggcggaggtcgtcacctccaagggcctcacctccgaccaacccatcctcatcgtcgactag

SEQ ID NO: 492 - protein, 417 aa, Oryza sativa
MAPPSDSDDSAPIPAGAISKLLIVIAMQTEALPLVNKFHLVEAEESISEANSYLCGTRLTDFLKVPHGLDTMATTKAFTLTLYGLEKILFSSLKPDLIINAGTAGGFKAKGADIGDVYLASDVAFHDRRIPIPVFDMYGIGTRKTFATPNILKELNLKVGKLSTGDSLDMSPHDESAILNNDATVKDMEGAAVAYVADMFSTPAIFVKAVTDIVDGEKPTAEEFLQNLVAVTAALDKAVTEVMELDTDPTKLKAKPIIKPKVEPCDDDDELPPPPPPASGSGEDWEATTPLAAGNPFFTALIAKSHLHPKFQMWIPPRFQHRLAEPEARTAAVLHSGGKSWATSYCGHLKMKKLDAGWSEFAVDNRLLVGDACVFELVAMGAAGGLEFQVQILRGGLPAEVVTSKGLTSDQPILIVD

SEQ ID NO: 493 - DNA, 789 bp, Oryza sativa
atggccgggatcgtggtggtgttcgacttcgacaagacgatcatcgacgtcgacagcgacaactgggtcgtggacgggctcggcgcgacggaggagttcgagcggctgctgcccaccatgccgtggaacaccctcatggacaccatgatgggcgagctccacgcgagcggcaagtcgctcgccgacgtcgcgggcgtgctcaggcctgctacggcctgggctgcgacctccggggatcctcagcgacgccaaccgcgttcttcatcgagcaccatcctcgaccaccacggcctcacgggttacttctccgagatcaacaccaacccgagcgccgtcgacgccgccaccggccgcctccgcatcgcgccgtaccacgacttccacgccggcccgcacgggtgcggcctcgggatctgcccgcccaacatgtgcaagggccaggtgctcgaccgcatccgggcctccgccggcgccgccggcaagagggtcatctacctcggtgacggccgcggcgactactgcccgtcgctccgcctcggccgcgacgacttcatgatgccacgcaggggcttccccgtgtgggagctcatctgcgaggacccgtcgctgctccacgcggaggtgcactcgtgggccgacggcgccgagatggaggagacgctgctgcggctggtcggcagggtgctcctcgaggagaggaacctgccgccgctcgactgcaagctcgagtcgttgccggccgtcgccgtgcaggacggcatgcccatgacgctccggatcaagaactga

SEQ ID NO: 494 - protein, 262 aa, Oryza sativa
MAGIVVVFDFDKTIIDVDSDNWVVDGLGATEEFERLLPTMPWNTLMDTMMGELHASGKSLADVAGVLRPATAWAATSGDPQRRQPRSSSSTILDHHGLTGYFSEINTNPSAVDAATGRLRIAPYHDFHAGPHGCGLGICPPNMCKGQVLDRIRASAGAAGKRVIYLGDGRGDYCPSLRLGRDDFMMPRRGFPVWELICEDPSLLHAEVHSWADGAEMEETLLRLVGRVLLEERNLPPLDCKLESLPAVAVQDGMPMTLRIKN

SEQ ID NO: 495 - DNA, 1035 bp, Oryza sativa
atggcaacatcctttctcttctctctcattctcctcctcatcactgccctttctcttccctttcctctccatgcgtcatctgtagaccccttgagcgccggtgcgaccaccgtccgctactggaatcgcaagattcctaacaatgctcctcaccccgacttcttcctttcactcctctcccctcttcccgcatctgtctcctcttccctctcctctccgctctccatatccccatccatctgccgctctgctcgcctcctctgccctaactctacctattttcagtccctctcaagcactgtcttcatagatggatgcacctttagttactcatgcaccttcacatacgaacataccaacatcactataaagcctggtatattttttcgggagcaagaattgaaagaggggaatgtggtcagaatgccagatatagcgaatgagttgacgacggctcgttcgtcgttccttccccgatcgatcgcggataggatcccattcaaggctgaggctgtcaagtccctgttcgggctagagccaaacacaaccttggcaaaggctgtggatgaaacggtggcgcaatgccagagctcgccaagcaagggcgagacgaagcggtgcgtcacatcagcagaggacatgatcgactttgccgtggcgatgttaggtgatgacattgtggttcggagtaccgtactgccaaatgggcccggcgagtcgatcatgattggtaaggtcaagggaataaatggtggcaagattaccagctcggtatcatgccacgaatacttatttccatacatggtatactactgccactcggtgcctaaaatcagagtttatgaggccgagatcctgtccgtccagacgaaggagaagatcaacagcggtgtcgccatctgtcacattgacacgtctgcctggaatgctgggcatcctgcttttgtggcactaggtgggaagccaggtcagaacaaggtctgccactggatatttaatggctctatgacctgggtcatcgccgacaaatcctaa

SEQ ID NO: 496 - protein, 344 aa, Oryza sativa
MATSFLFSLILLLITALSLPFPLHASSVDPLSAGATTVRYWNRKIPNNAPHPDFFLSLLSPLPASVSSSLSSPLSISPSICRSARLLCPNSTYFQSLSSTVFIDGCTFSYSCTFTYEHTNITIKPGIFFREQELKEGNVVRMPDIANELTTARSSFLPRSIADRIPFKAEAVKSLFGLEPNTTLAKAVDETVAQCQSSPSKGETKRCVTSAEDMIDFAVAMLGDDIVVRSTVLPNGPGESIMIGKVKGINGGKITSSVSCHEYLFPYMVYYCHSVPKIRVYEAEILSVQTKEKINSGVAICHIDTSAWNAGHPAFVALGGKPGQNKVCHWIFNGSMTWVIADKS

SEQ ID NO: 497 - DNA, 417 bp, Oryza sativa
atggctatgggtaagaccactctttactggtacactcctccatacaaaattggtgatatcgatgtgtctacaagatggagtcacgcacgattcccacttaactacaacgccaatagcttgactagggtgttgacccggtctaggtcctcgtctcctcggatggatccagtgctaaatggcgacctttggttgatgaccaatgtcgatgactactccctggttgtgttggttgatcatctacgggttgatgaccatgcttgtcgcacactggcgtttttcctcgttatgccaatgacggttgcaccgacacattccactatttttgtcgatatgtctgaatataatggttttattgtgaatattaccattgtcggaggtattgattatctcctgatggctatgtccaagggacattag

SEQ ID NO: 498 - protein, 138 aa, Oryza sativa
MAMGKTTLYWYTPPYKIGDIDVSTRWSHARFPLNYNANSLTRVLTRSRSSSPRMDPVLNGDLWLMTNVDDYSLVVLVDHLRVDDHACRTLAFFLVMPMTVAPTHSTIFVDMSEYNGFIVNITIVGGIDYLLMAMSKGH

SEQ ID NO: 499 - DNA, 681 bp, Oryza sativa
  misc_feature (513)..(513): s = guanine or cytosine
atggaggtggaccatcccctcctgtcattggctataatgcccccaagacctcaactcttcttcaaggattcatcagagaaccagccgatacaggttttagccgatctcttctcttttgacattagagattatcttaacgaagaaacagaagaagacaccaccagcaaatctttggttctcttgcccgatgacgtgaagaaaacactcgaagacatatctcatcggctggaagcatcgtcactagacaacttggtggtaaacttctatcttgaacaacatcaattcaagctggagaaggccaagctaagactagccgaacgtcgggagcgcaaggacattgaagccacaatccaagccaatcgacagcttgttcatgaagagaagaccaaacttgatcagctatctaagggtccgattaagtccaatattgatcggctcgaagctcgcaagattgagctcttggcacaacttgaagaatgcaatgccgagctggatatggaacatagaaaccgsgcctcgccgctgctgtggccgtcgccgccgccttccgtcgctgccatcgggttcacacggtggaggagcaccccgtccgccccttcgcagccgccgaagaccgccgccgtcggacctcgtcgccggccgtcgttcgtcgtcgtccgtcattgtgctttgtaccggtga

SEQ ID NO: 500 - protein, 226 aa, Oryza sativa
MEVDHPLLSLAIMPPRPQLFFKDSSENQPIQVLADLFSFDIRDYLNEETEEDTTSKSLVLLPDDVKKTLEDISHRLEASSLDNLVVNFYLEQHQFKLEKAKLRLAERRERKDIEATIQANRQLVHEEKTKLDQLSKGPIKSNIDRLEARKIELLAQLEECNAELDMEHRNRASPLLWPSPPPSVAAIGFTRWRSTPSAPSQPPKTAAVGPRRRPSFVVVRHCALYR

SEQ ID NO: 501 - DNA, 1668 bp, Oryza sativa
  misc_feature (944)..(944): m = adenine or cytosine
atggcgttcggacgccgttcactcttcttgccggtggtgggcgtcgcggccatcctgctgctcgccgccggccacgcgaccgccgtcaacaccggcgagaccgtcgtgttctggggccggaacaaggacgagggctctctccgtgaggcctgcgacaccggcctctacacctccgtcatcatctccttcctcgccgtcttcggccacggccgctactccctcgacctctccggccacgacgtctccgccgtcggcgccgacatcaagcactgccagtccaagtacatccccgtgctcctctccatcggcggccagggcggcgcctactccctccccaccaacgcctccgccgccgacgtcgccgaccacctctgggactccttcctcggcggcggccgagccggcgtgccccgccccttcggcgacgcggtggtggacggcgtcgacctcttcatcgaccagggcggcgccgagcactacgacgagcttgcccggcggctgttcagccactacaagttcgagatgctgctgacggcgacgacgaggtgctcgtacccggaccaccgcctcgacatggcgctggcgacggggctgttcacgcacatccacgtccgggtgttcggcggcggcggcgacgccggctgcacgacgcgccacagggcgtcgtgggagaggtgggcggcggcgtaccccggcagcctggtgtacctcggcgtggtggcctcgccggagcaggacgccaacgcctacctgccgcgtaaggttctcttctccgacgtgctcagccacatcgtcgagaagcccaactatggtggattgatgatctgggatagctggccgttttcttcctgctgctcgccggccagttaaccgccggcgaagaccagaccgccgtaatctggggccgccacggcgacgagggcaccctccgtgaggcctgcgamaccggccactacaacaccgtcatcatctccttcctcagcgtttttcggccacggccgctactccctcgacctctccggccacgacctccgccgcgtcggcaacgacatcaagcactgccagcgcaagggcatcgtcgtgctcctctccatcggcggccagggcggcgactattccctcccctcctcccgctccgccgccgacgtcgccgacaacctctggaacgcgttcctcgccggccgccgcaagggcgtgctccggccattcggcaacgcggcggtcgacggcatcgacttcttcatcgaccggggctccggcgaccactacgacgagctggccaggaagctctacagctacagaaacaacaaggggaagggggtgatgctgacggcgacgccgcggtgcaggttcccggaccggcggctggagaaggcgctggcgacgggggtgttcgcgcgcatccacgtgaggatgttcggcgacgacgtgaactgcacggcggcgccgagggagtcgtgggagaagtgggcggcggcgtacccggcgagccaggtgtacctcgggctggtggcctcgtcggagcaggacccgggatacctgtcgcccaagccactctactacacgctggtgatgtacatcagagacaggctcaactaccggtgccaagatgatctggacaggtactacgacaagaagaccgactactccattggaaaacttatttaa

SEQ ID NO: 502 - protein, 440 aa, Oryza sativa
  misc_feature (177)..(177): Xaa = any naturally occuring amino acid
  misc_feature (273)..(274): Xaa = any naturally occuring amino acid
  misc_feature (279)..(279): Xaa = any naturally occuring amino acid
  misc_feature (290)..(290): Xaa = any naturally occuring amino acid
  misc_feature (299)..(299): Xaa = any naturally occuring amino acid
  misc_feature (315)..(315): Xaa = any naturally occuring amino acid
WRSDAVHSSCRWWASRPSCCSPPATRPPSTPARPSCSGAGTRTRALSVRPATPASTPPSSSPSSPSSATAATPSTSPATTSPPSAPTSSTASPSTSPCSSPSAARAAPTPSPPTPPPPTSPTTSGTPSSAAAEPACPAPSATRWWTASTSSSTRAAPSTTTSLPGGCSATTSSRCCXRRRRGARTRTTASTWRWRRGCSRTSTSGCSAAAATPAARRATGRRGRGGRRRTPAAWCTSAWWPRRSRTPTPTCRVRFSSPTCSATSSRSPTMVDXXSGIAXPFSSCCSPASXPPAKTRPPXSGAATATRAPSVRPAXPATTTPSSSPSSAFSATAATPSTSPATTSAASATTSSTASARASSCSSPSAARAATIPSPPPAPPPTSPTTSGTRSSPAAARACSGHSATRRSTASTSSSTGAPATTTTSWPGSSTATETTRGRG

SEQ ID NO: 503 - DNA, 682 bp, Oryza sativa
  misc_feature (237)..(237): h = adenine, cytosine, or thymine
atggcgccgacgtcgaagctgtcgcagggcatcaagaaggcgtcgcggtcgcacacgtaccaccgccgcgggctgtgggccatcaaggccaagcacggcggcgccttccccaaggccgagaagcccgccgccgcagccgccgccgccgcgcccaagttctaccccgccgacgacgtcaagccccgccagcccagcacccgcaagcccaaccctaccaagctcaggaggtcgtccathacgcctgggacagtgctgatcctgctcgccgggaggttcatggggaagcgcgtcgtgttcctcaagcagctcaaatccggcctgcttctcgtcaccgggaccttttaagatcaatggagttccgatccgccgtgtgaaccagccctacgtcattgctacgtccacaaaggttgatatctctggtgttaatgtggagaagtttgatgacaagtacttctctagggacaagaagcagaaggcgaagaagaccgagggtgaactttttgagactgagaaggagttcttttaggcaaccaagaacctgccggagttcaaaaaggaggaccagaaagttgtggatgccgagttgatcaaagctattgaagctgtcccggatctgaaaacttaccttggtgcgcggttttctctcagggacggcgacaagccccacgagatggttttctag

SEQ ID NO: 504 - protein, 228 aa, Oryza sativa
  misc_feature (49)..(50): Xaa = any naturally occuring amino acid
  misc_feature (177)..(177): Xaa = any naturally occuring amino acid
MAPTSKLSQGIKKASRSHTYHRRGLWAIKAKHGGAFPKAEKPAAAAAAXXAAPKFYPADDVKPRQPSTRKPNPTKLRRSSITPGTVLILLAGRFMGKRVVFLKQLKSGLLLVTGPFKINGVPIRRVNQPYVIATSTKVDISGVNVEKFDDKYFSRDKKQKAKKTEGELFETEKEFFXATKNLPEFKKEDQKVVDAELIKAIEAVPDLKTYLGARFSLRDGDKPHEMVF

SEQ ID NO: 505 - DNA, 2877 bp, Oryza sativa
  misc_feature (2260)..(2260): r = adenine or guanine
atggccgcttccgtgcagccgcggcagttcggccacctcgagccgggctccgcgccggtgtgcggcgccgcatcctcgaacggcgccaaggcgtaccctcccgcgaacggcatcccgcgccgcgccgactcaccggtgcgcgggtgcggcttccctcccctcgtctcgccaccttcgcggaagccgcccagcgatgggtcggacgacgaggaggaggagcaggaggactggcgggagctgtacggctcgcacctgcagctggaggtggaaccgtcggtgcgcgacgcgcgcaacgagggcaccgccgacgcgtggatcgagcgcaacccgttgctgatccggctcaccgggaaacacccgctgaactgcgaggcgccgctggcgaggctcatgcaccacggcttcatcaccccggctgcgctgcacttcgtgcgcaaccacggcgcagtgccgcggggtgactggtcgacgtggaccgtcgaggtgacggggctcgtcaagcgtcccatgcggctcaccgtggacgagctggtcaacggcttccccgccgtggaggtccccgtcacgctggcctgctcggggaaccgccgcaaggagcagaacatggtgcagcagactgtggggttcaactttggcgccgccgccgtgtccacgtcggtgtggcacggcgcccgcctccgcgacgtgctccggcggtgcggcatcatgcccagcaagggcggtgcgctcaacgtgtgcttcgagggcgccgaggacctccccggcggcggcggctccaagtacggcaccagcatcacacgccagtgggcgctggacccgtcgcgggacatcatgctcgcctacatgcagaatggcgagccgctgctccccgaccacggcttccccgtccgcgccatcatccccggctgcaccggcggccgcatggtcaagtgggtcaagcgcatcatcgtcaccaccgccgagtccgacaactactaccattacaaggacaaccgcgtcttcccgtcccatgtcgacgccgagctcgccaacgccgatgcgtggtggtacaagccggagtacatcatcaacgagctgaacgtgaactcggtgatcacggcgcccgggcacgacgagatcctgcccatcaacggcatcaccacgcagcgcggctacaccatgaagggatacgcctactccgtgaatagtggtaatcaaatccaacaaatatcttctgaattttctgacagaataataccccatcagcatatggagtacatagctaaagtactgtactacatatttcgagctatcaaaatttttgttgtaagatttaagtacccaaggcggcggcaagaggatcacgcgggtggaggtgacgctggacggccggcgagacatggctggtgtgcgtgctggacctcccggagaagccccaccaagtacggcaagcactggtgctggtgcttctggtccgtcgaggtcgaggtgctcgacctcctcggcgccaaggagatcgccgtgcgcgcctgggaccagtcgcacaacacccagcccgagaagctcatctggaatctcatggggatgatgaacaactgctggttcaaggtgaaggtgaacgtgtgccggccgcacaagggtgagatcgggctggtgttcgagcacccgacgcagcccgggaaccagaccggcgggtggatggcgaggcagaagcacctggagacggcggaggcggccgcaccggggctgaagcggagcacgtcgacgccgttcatgaacaccaccgacggcaagcagtttaccatgtccgaggtgcgcaagcactcgtcgcaggactcggcgtggatcgtcgtccacggtcacgtctacgactgcacggccttcctcaaggaccaccccggcggcgccgacagcatcctcatcaacgccggcaccgactgcaccgaggagttcgacgccatccactccgacaaggccaaggcgctcctcgacacctaccgcatcggcgagctcatcaccaccggcgccgggtacagctccgacaactccgtccacggcgcgtccaacctctcccagctcgcccccatccgcgaggccatcaaggcgccggcgcccgtcgcgctctccagcccgcgcgacaaggtcccctgccaactcgtcgacaagaaggagctctcccgcgacgtccgcctcttccgcttcgcgctgccgtcctccgaccaggtgctcggcctccccgtcggcaagcacatcttcgtgtgcgccagcatcgaagggaacrctgtgcatgcgggcgtacacgccgaccgagcactggtcgaccgacggtgtacttcaacgaacgagcaccccaagttccccgatggcgggctcatgacgcagtacctggactcgctccccgtgggcgcctacatcgacgtcaaggggccactcggccacgtcgagtacaccggccgcggcgagttcgtcatcaacggcaagccgcggaacgcgcggcggctggcgatgatcgccggcgggagcgggatcacgcccatgtaccaggtcatccagtcggtgctgcgcgaccagccggaggacacgacggagatgcacctggtgtacgcgaaccggacggaggacgacatcctcctccgcgacgagctcgaccggtgggcggcggagtacccggacaggctcaaggtgtggtacgtcatcgaccaggtgaagcggccggaggaagggtggaagtacggcgtcgggttcgtcacggaggaggtgctgcgggagcacgtgccggagggcggcgacgacacgctcgcgctcgcctgcgggccgccgccgatgatcaagttcgccgtctcgccgaacctggagaagatgaagtacgacatggccaattctttcatcgtgttctaa

SEQ ID NO: 506 - protein, 958 aa, Oryza sativa
MAASVQPRQFGHLEPGSAPVCGAASSNGAKAYPPANGIPRRADSPVRGCGFPPLVSPPSRKPPSDGSDDEEEEQEDWRELYGSHLQLEVEPSVRDARNEGTADAWIERNPLLIRLTGKHPLNCEAPLARLMHHGFITPAALHFVRNHGAVPRGDWSTWTVEVTGLVKRPMRLTVDELVNGFPAVEVPVTLACSGNRRKEQNMVQQTVGFNFGAAAVSTSVWHGARLRDVLRRCGIMPSKGGALNVCFEGAEDLPGGGGSKYGTSITRQWALDPSRDIMLAYMQNGEPLLPDHGFPVRAIIPGCTGGRMVKWVKRIIVTTAESDNYYHYKDNRVFPSHVDAELANADAWWYKPEYIINELNVNSVITAPGHDEILPINGITTQRGYTMKGYAYSVNSGNQIQQISSEFSDRIIPHQHMEYIAKVLYYIFRAIKIFVVRFKYPRRRQEDHAGGGDAGRPARHGWCACWTSRRSPTKYGKHWCWCFWSVEVEVLDLLGAKEIAVRAWDQSHNTQPEKLIWNLMGMMNNCWFKVKVNVCRPHKGEIGLVFEHPTQPGNQTGGWMARQKHLETAEAAAPGLKRSTSTPFMNTTDGKQFTMSEVRKHSSQDSAWIVVHGHVYDCTAFLKDHPGGADSILINAGTDCTEEFDAIHSDKAKALLDTYRIGELITTGAGYSSDNSVHGASNLSQLAPIREAIKAPAPVALSSPRDKVPCQLVDKKELSRDVRLFRFALPSSDQVLGLPVGKHIFVCASIEGNAVHAGVHADRALVDRRCTSTNEHPKFPDGGLMTQYLDSLPVGAYIDVKGPLGHVEYTGRGEFVINGKPRNARRLAMIAGGSGITPMYQVIQSVLRDQPEDTTEMHLVYANRTEDDILLRDELDRWAAEYPDRLKVWYVIDQVKRPEEGWKYGVGFVTEEVLREHVPEGGDDTLALACGPPPMIKFAVSPNLEKMKYDMANSFIVF

SEQ ID NO: 507 - DNA, 1209 bp, Oryza sativa
atggacgccgcggcggcgtcctcctcctcctcctcgtcggcgacgatggcggcggcggcggcgtcggccgcggaggcgtcgttgtccggctcgcctgcttcttcgaggaacgctcgccatcggcagcgtaagggggtccggctccggatgctgcgacggcggggggcggcagccttgtggaggccgaggcgcgccccgggcgatgggggcggtggcgccgtgcaggaggatctcgcgctgcctctcggaatgtccttcgccgccgtcctcgcgcaggcaaaccctgaagaaagtagtagtactagtacttttttcttccttggcgctgttcgtgatcctctctgcgatgttcgtgccatcaaatgtactagcatattgcgtgtagattctgttgctagcgtctcacgaacacgcttgagctcatctgatttgcaaaatcagacaaacagaatagagcatgaccttgtgaacacagtggaaagtcaactagttctctttgccagtgacaatcagcagttaacgcatcttcggcatagcagatcctctcctgaagctgataatcgcattcttaatgccattgatcgctcgaacgaactcaaggaatttgaaatagggcttaccatgagaaagttgcaactcaaacagtcacagttagctcttagttcccattcacacatgttagagaagattaagctatctttcggatttcagaaagcttccttcaaaggagagaaattcaagactcgcatgcaggagacaagagacgcagaaatccttaggacgctaatagattttcttgttagtgctgtgatagttatgtcagcgtgctttggatatggaacttatatttattcgtatcaaaggataacggatgttacgtcagcttgttctgccacatcaaagcgttcctcaactactgggtcaaatatgcctataacattcaatctcattttgctgggaattatctgcggctttgctggaaggttttgtaccaatacactaggtggcgatggaaacacttggctcatgtactgggagcaagttgtctggttaccatactgggttcgccggtgcttgttttatgctgcggtggggcttattcttccagccttgactggcttgctcccgtttgcctctctttctgactggaaggatcattttgtggaagagataaaatccattgttatcggtgacaagattgaagcatga

SEQ ID NO: 508 - protein, 402 aa, Oryza sativa
MDAAAASSSSSSSATMAAAAASAAEASLSGSPASSRNARHRQRKGVRLRMLRRRGAAALWRPRRAPGDGGGGAVQEDLALPLGMSFAAVLAQANPEESSSTSTFFFLGAVRDPLCDVRAIKCTSILRVDSVASVSRTRLSSSDLQNQTNRIEHDLVNTVESQLVLFASDNQQLTHLRHSRSSPEADNRILNAIDRSNELKEFEIGLTMRKLQLKQSQLALSSHSHMLEKIKLSFGFQKASFKGEKFKTRMQETRDAEILRTLIDFLVSAVIVMSACFGYGTYIYSYQRITDVTSACSATSKRSSTTGSNMPITFNLILLGIICGFAGRFCTNTLGGDGNTWLMYWEQVVWLPYWVRRCLFYAAVGLILPALTGLLPFASLSDWKDHFVEEIKSIVIGDKIEA

SEQ ID NO: 509 - DNA, 1059 bp, Oryza sativa
atggctccagccattgccaagcctctcctgagcgatctggtggcacaatccgggcaagtcccctcgagccacattcgtccggttggcgaccgcccggacctcgacaacgtcgaccacgagtccggcgccggcattccggtcatcgacctgaaacagctcgacggcccggatcgccgcaaggttgtcgaggccatcggttcggcgtgcgaaaccgacggttttttcatggtgaagaatcacgggatcccggaggaggtggtggaagggatgctgcgcgtggcgagggagttcttccacatgccggagtcggagcggctcaagtgctattccgacgaccccaagaaggcgatccggctgtcgacgagcttcaacgtgcgcaccgagaaggtgagcaactggcgcgacttcctgcgcttgcattgctaccctctcgagagcttcatcgaccagtggccctccaacccaccctccttcaggcaagtggtcggcacctactcgagggaggcgagggcgctggcgctgcggttgctggaggcgatatctgagagcctcgggctggagaggggccacatggtgtcggccatggggcggcaggcgcagcacatggcggtgaactactatccgccatgcccacagccggagctcacctacggcctgccggggcacaaggaccccaatgccatcacgctgctgctccaggacggcgtctccggcctgcaggtccagcgcaacggccgctgggtggccgtcaaccccgtgcccgacgccctggtcatcaacatcggagatcaaatccaggcgctgagcaacgaccggtataagagcgtgctccaccgggtgatcgtgaacagcgagagcgagaggatctccgtgccgacgttctactgcccgtccccggacgcggtgatcgcgccggccggcgcgctggtggacggcgccctgcacccgctggcgtaccggcccttcaagtaccaggcctactacgacgaattctggaacatgggcctccagtccgccagctgcttagaccggttccggcctaacgatcaggccgtctga

SEQ ID NO: 510 - protein, 352 aa, Oryza sativa
MAPAIAKPLLSDLVAQSGQVPSSHIRPVGDRPDLDNVDHESGAGIPVIDLKQLDGPDRRKVVEAIGSACETDGFFMVKNHGIPEEVVEGMLRVAREFFHMPESERLKCYSDDPKKAIRLSTSFNVRTEKVSNWRDFLRLHCYPLESFIDQWPSNPPSFRQVVGTYSREARALALRLLEAISESLGLERGHMVSAMGRQAQHMAVNYYPPCPQPELTYGLPGHKDPNAITLLLQDGVSGLQVQRNGRWVAVNPVPDALVINIGDQIQALSNDRYKSVLHRVIVNSESERISVPTFYCPSPDAVIAPAGALVDGALHPLAYRPFKYQAYYDEFWNMGLQSASCLDRFRPNDQAV

SEQ ID NO: 511 - DNA, 2934 bp, Oryza sativa
  misc_feature (33)..(33): y = cytosine or thymine
  misc_feature (36)..(36): m = adenine or cytosine
  misc_feature (138)..(138): k = guanine or thymine
  misc_feature (1972)..(1972): k = guanine or thymine
atggcattcccgagcggcaaagcctactacctycamctcctcctgctcgcgatcctgccaagcctcgtcgcgcggcgcggcgcggcgcagcagggcggcgtcgacgagaagcagctcctgctccaggtcaagcgcgcktggggggaccccgcggcgctcgcgtcgtggacggacgcggcgccgcactgccgctgggtgtacgtgtcctgcgacggcggcggcaccggccgcgtcacgtcgctgtccctccccaacgtcgcggtcgccggcgccgtccccgacgccatcggcgggctgacggcgctcacggtgctcaacctccagaacaccagcgtcggcggcgtgttcccggcgttcctctacaacctcaccgcgatcacctccatcgacctctcgatgaacagtatcggcggcgagctccccgccgacattgaccggctcggcaagaacctgacctacctcgccttgaacaacaacaacttcaccggcgtgataccggcggcggtgtcgaagctcaagaacctgaaggtgtttaccctcaactgcaaccagctcaccggcacgatcccggcggcgctcggcgagctcactagcctcgagacgctcaagctcgaggtgaatcagttcacccccggcgagctgccgggatcgttcaagaacttgacgagcctgaagacggtctggctggcgcagtgcaacctcaccggcgatttccccagctacgtcacagagatgatggagatggagtatctcgacctgtcccagaattcattcaccggaagcatacctcctgggatttggaacattccaaagctgcagtacttgttcctgtacaccaaccagctcaccggcgacgtcgtcgtcaatggcaagattggagcagcgagcttaatttatctcgacatatctgagaaccagctgactggaacgatcccagagagctttggaagtttgatgaacctaactaacttagccttgatgacgaacaacttctccggcgagataccggcgagccttgctcagcttccatcgctggtgataatgaagctgttcgagaacaatctcaccggtcagattccggcggagctcgggaagcactcgccatttctgagagacatcgaggtcgacaacaacgacctcaccgggccaataccggagggggtctgcgacaaccgccggttgtggatcatctccgccgccggcaaccggttgaacggctcaattccggcgagtcttgccacttgcccggcgctgctgagtctccagctccaggacaacgagctttccggcgaggtgccggcggcgctgtggacggagacgaggctgatcaccgtgctcctgcagaacaatggacacctcaccggaagcctgccggagaagctgtattggaatctgacgaggctttacatccacaacaaccgtttcagtggccggcttccggcgacggccaccaagctccagaagttcaacgccgagaacaacttgttctccggcgagatacctgacgggttcgccgccgggatgccattgctgcaggagctggacctgtcaaggaatcagctctccggggccatcccgatcccggccgcgctcgccatctccgcctacgaccagagcttcctcggcaaccccggtctctgcgtatcggcggcgccggcgggtaacttcgcgggcctgcgctcgtgcgccgcgaaggcatccgacggcgtatcgccgggtctccggtcgggtctcctcgccgccggcgcggccctcgtcgtcttgatcggggcgctcgccttcttcgtcgtccgcgacatcaagaggcggaagcggctcgcgcggacagagccggcatggaagatgaccccattccagcccctcgacttcagcgaggcctcccttgtgcgcgggctcgccgacgagaacctcatcggcaagggcggcgcggggcgcgtgtaccgcgtcgcgtacgccagccggagcagcggckgcgccggcggcaccgtcgccgtgaagcgcatatggaccggcggcaagctggacaagaacctggagcgcgagttcgattcggaggtggacatcctcggccatgtccgccacaccaacatcgtgaagctcctctgctgcctctcccgcgcggagacgaagctcctcgtgtacgagtacatggagaacggcagcctcgacaagtggctccacgggaacaaattgctggccggtggcgcgacggcgagggcgccgtcggtccggcgaacgccgctggactggctggcgagggtcagggtggccgtcggcgcggcgaggggcctctgctacatgcaccacgagtgctcgccgccgatcgtgcaccgggacatcaagtccagcaacatcctgctcgacgctgagctcatggccaaggtcgccgacttcgggctcgcccggatgctggtccaggccgggacgccggacaccatgaccgccgtcgccggatcgttcggctacatggctcccgagtgcgcgtacacgaggaaggtgaacgagaaggtcgacgtgtacagcttcggggtggtgctcctcgagctgatcaccggcagggaagcccacgacggcggcgagcacggctcgctggcggagtgggcgtggcggcacctgcaatcgggcaggagcatcgccgacgcggtggacaggtgcatcaccgacgccgggtacggcgacgacgccgaggtcgtgttcaagctcggcatcatctgcaccggcgcgcagccggcgacgaggccgacaatgagggacgttctgcagattctggtgaggtgcgagcaggcgctccagaacaccgtggacgggaaggtggcggagtacgacggcgacggcgcgccgtttctgccgatcaggggtggcagccgccggaagcagctttcggacaccaaaggcatcgacgacggcaacggcagcttggacagcatagtatga

SEQ ID NO: 512 - protein, 977 aa, Oryza sativa
MAFPSGKAYYLQLLLLAILPSLVARRGAAQQGGVDEKQLLLQVKRAWGDPAALASWTDAAPHCRWVYVSCDGGGTGRVTSLSLPNVAVAGAVPDAIGGLTALTVLNLQNTSVGGVFPAFLYNLTAITSIDLSMNSIGGELPADIDRLGKNLTYLALNNNNFTGVIPAAVSKLKNLKVFTLNCNQLTGTIPAALGELTSLETLKLEVNQFTPGELPGSFKNLTSLKTVWLAQCNLTGDFPSYVTEMMEMEYLDLSQNSFTGSIPPGIWNIPKLQYLFLYTNQLTGDVVVNGKIGAASLIYLDISENQLTGTIPESFGSLMNLTNLALMTNNFSGEIPASLAQLPSLVIMKLFENNLTGQIPAELGKHSPFLRDIEVDNNDLTGPIPEGVCDNRRLWIISAAGNRLNGSIPASLATCPALLSLQLQDNELSGEVPAALWTETRLITVLLQNNGHLTGSLPEKLYWNLTRLYIHNNRFSGRLPATATKLQKFNAENNLFSGEIPDGFAAGMPLLQELDLSRNQLSGAIPIPAALAISAYDQSFLGNPGLCVSAAPAGNFAGLRSCAAKASDGVSPGLRSGLLAAGAALVVLIGALAFFVVRDIKRRKRLARTEPAWKMTPFQPLDFSEASLVRGLADENLIGKGGAGRVYRVAYASRSSGRAGGTVAVKRIWTGGKLDKNLEREFDSEVDILGHVRHTNIVKLLCCLSRAETKLLVYEYMENGSLDKWLHGNKLLAGGATARAPSVRRTPLDWLARVRVAVGAARGLCYMHHECSPPIVHRDIKSSNILLDAELMAKVADFGLARMLVQAGTPDTMTAVAGSFGYMAPECAYTRKVNEKVDVYSFGVVLLELITGREAHDGGEHGSLAEWAWRHLQSGRSIADAVDRCITDAGYGDDAEVVFKLGIICTGAQPATRPTMRDVLQILVRCEQALQNTVDGKVAEYDGDGAPFLPIRGGSRRKQLSDTKGIDDGNGSLDSIV

SEQ ID NO: 513 - DNA, 645 bp, Oryza sativa
atggagtctagtacgctactgaaggacaccatgatctcaactagggctaaaatttacaagctctatatgcccagatgtacaggcttgactgctgaaggtgtggtgaagattgtccaggttctttatgaatgcaaggggaatctaaaccgcattcgactccatggtatttgcaggatgactaagcatcatcttgatgctatcagttctgccatgtgcaagggtaaccaacaagaagatgatcaatcacttttctatagccacagagtccatgaagtgctcaacaccaacgatgaacgccgtattgatgttgatgtgtgccctatgtgcacaaatgtgaggctggtgtttgattgtacaagggatggctgtaggagaaaggatagttgggctcaatgtcgaggctgcttcttctgtgttgcccgatgcgaaacatgcggtgggtgcatcgacttggaggagctcagcgagactgaacttgcatgctcggacttcctgtgcatggagtgctggcttccgctcccgaaatgtagcacttgcaatcggccctactgcaagaggcatgaaaatctgaaggattctgaattatttattgatcacgtcaaatttagcgggtgcagacttcatggacttgtgcaacttgtctga

SEQ ID NO: 514 - protein, 214 aa, Oryza sativa
MESSTLLKDTMISTRAKIYKLYMPRCTGLTAEGVVKIVQVLYECKGNLNRIRLHGICRMTKHHLDAISSAMCKGNQQEDDQSLFYSHRVHEVLNTNDERRIDVDVCPMCTNVRLVFDCTRDGCRRKDSWAQCRGCFFCVARCETCGGCIDLEELSETELACSDFLCMECWLPLPKCSTCNRPYCKRHENLKDSELFIDHVKFSGCRLHGLVQLV

SEQ ID NO: 515 - DNA, 1260 bp, Oryza sativa
  misc_feature (534)..(534): s = guanine or cytosine
  misc_feature (594)..(594): y = cytosine or thymine
  misc_feature (606)..(606): y = cytosine or thymine
atgcaggacgacgacgacgacgaccagcacatgcacagcatgtctcgctggcgcgcggcgacggcggcggccgggagagaaccaccacctctccccttcccgcgctacgcgggacgaggaccagggatggctccccccaccgccgtctccgcctccaccgccggcctgatctggtccttgtcgccctcgctctcgctcgtcgtcaccacctcggtggcgcttctgctcgtgctcggcggtgtgtccgggatccgcgtcaacgtcatccggctcccgtcggcgtcgccgttcccggcgttccgggaggcgccggcgttcaggaatggcgacgggtgcccgccggcgagggggtcggcggcggcggagggggggcgggtggacgtggccatgacgctcgacgccaactacctgaggggcaccatggccgccgtgttctccatcctgcagcacacggcgtgcccggagagcgtcgcgttccacttcctcgccgcgcgctccgacccggacgccggcgacctcgccgccgccatccgsgccaccttcccctacctcggcgccgccgtcagcgtctaccgcttcgacccgtcgcgcgtycgcggccgcatytcccgctcggtgcgccgcgcgctcgaccagccgctcaactacgcgcgcgtctacctcgccgacacgctccccgccggcgtgcgccgcgtcctctacctcgactccgacgtcgtcgtcgtcgacgacgtgcggaagctctggtcggtggacctcgccgggcacgtggtggcggcgccggagtactgccacgccaacttcaccaagtacttcaccgacgcgttctggtcggacggcgagctcagcggcgccgcgttccgacgcggccgccgccggccgccgtgctacttcaacaccggcgtgatggtgatggacatggggcggtggcgcgacggcgggtacacgcggcgggtggaggagtggatggcggtgcagaagcggaggcggatctaccacctcggctcgctgccgccgttcctgctggtgctcgccggcgacatcaaggcggtggatcaccggtggaaccagcacgggctcggcggcgacaacgcggaggggaaatgccggagcctgcacccgggcccggtcagcctcctccattggagtggcaaggggaagccatggctgcgcctcgactcgcggaagccctgcgccgtcgactacctctgggcgccgtacgacctctacaaggccgccgtacccgcgctcgaggagtga

SEQ ID NO: 516 - protein, 416 aa, Oryza sativa
MQDDDDDDQHMHSMSRWRAATAAAGREPPPLPFPRYAGRGPGMAPPTAVSASTAGLIWSLSPSLSLVVTTSVALLLVLGGVSGIRVNVIRLPSASPFPAFREAPAFRNGDGCPPARGSAAAEGGRVDVAMTLDANYLRGTMAAVFSILQHTACPESVAFHFLAARSDPDAGDLAAAIATFPYLGAAVSVYRFDPSRRGRSRSVRRALDQPLNYARVYLADTLPAGVRRVLYLDSDVVVVDDVRKLWSVDLAGHVVAAPEYCHANFTKYFTDAFWSDGELSGAAFRRGRRRPPCYFNTGVMVMDMGRWRDGGYTRRVEEWMAVQKRRRIYHLGSLPPFLLVLAGDIKAVDHRWNQHGLGGDNAEGKCRSLHPGPVSLLHWSGKGKPWLRLDSRKPCAVDYLWAPYDLYKAAVPALEE

SEQ ID NO: 517 - DNA, 306 bp, Oryza sativa
atgggtttgagctgcttgggtgctgggatgatggggaagaagaaggtgtcgccggcgaagcagcagcagcagcaacctgtagatcagaatcagcagcagaagaatctgtactgctcgaagtcgaaggatgcagatgctgctgaagttggtgagaaggagaagaagattggaggaggatcagatggtgatcatcatgctggtgtggagaaggtcgagatgaggaagaagaagagtggatcatcatcatcatcagctccaatcttgatgtaccagttccccttccactcccgccctggcttgctctga

SEQ ID NO: 518 - protein, 101 aa, Oryza sativa
MGLSCLGAGMMGKKKVSPAKQQQQQPVDQNQQQKNLYCSKSKDADAAEVGEKEKKIGGGSDGDHHAGVEKVEMRKKKSGSSSSSAPILMYQFPFHSRPGLL

SEQ ID NO: 519 - DNA, 1720 bp, Oryza sativa
  misc_feature (248)..(248): k = guanine or thymine
atggagtccatcgccgccgccacgttcacgccctcgcgcctcgccgcccgccccgccactccggcggcggcggcggccccggttagagcgagggcggcggtagcggcaggagggaggaggaggacgagtaggcgcggcggcgtgaggtgctccgcggggaagccagaggcaagcgcggtgatcaacgggagcgcggcggcgcgggcggcggaggaggacaggaggcgcttcttcgaggcggcggagcktgggagcgggaagggcaacctggtgcccatgtgggagtgcatcgtctccgaccacctcacccccgtgctcgcctaccgctgcctcgtccccgaggacaacatggagacgcccagcttcctcttcgagtccgtcgagcaggggcccgagggcaccaccaacgtcgtacggccttctggtcgctatagcatggtgggagcccacccagtgatggaggtcgtggcaaaggagcacaaggtcacaatcatggaccacgagaagggcaaggtgacggagcaggtcgtggatgatcctatgcagatccccaggagcatgatggaaggatggcacccgcagcagatcgatcagctccccgattccttcaccgggtggatgggtcgggttcttttcctatgatacagtccgttatgttgaaaagaagaagctgcccttctccggtgctccccaggacgataggaaccttcctgatgttcaccttgggctttatgatgatgttctcgtcttcgacaatgtcgagaagagaaagtatatgtcatccattgggtaaatcttgatcggcatgcaaccaccgaggatgcattccaagatggcaagtcccggctgaacctgttgctatctaaagtgcacaattcaaatgtacccaagctttctccaggatttgtaaagttacacactcggcagtttggtacacctttgaacaaatcaaccatgacaagtgatgagtacaagaatgctgttatgcaggctaaggagcatattatggctggtgatattttccagattgttttaagccagaggtttgagaggcgaacatacgccaatccatttgaagtctatcgagctttacgaattgtgaacccaagtccatacatggcatatgtacagaggcaagaggctgtgtcctggtagcatctagtccagaaattcttactcgtgtgaggaagaggtctccaaacctggatctgtgaaggtggagaaattaatgaacattgaacgctactcccatgtcatgcacatcagttccacgggtgagtggagagttggatgatcatctccaaagttgggatgccctgcgagccgcgttgcctgttggaacagttagtggagcaccaaagaggtgaaagccatggagctgatagacgagctagaggtcacaagacgaggaccatacagtggcggccttggagggatatcatttgacggagacatgcttatcgctcttgcactccgcaccattgtgttctcaacagcgccaagccacaacacgatgtactcatacaaagacaccgagaggcgccgggagtgggtcgctcaccttcaggctggtgctggcattgtcgctgatagcagcccagacgacgagcaacgtgaatgcgagaacaaggcagccgctctggctcgagccatcgatcttgctgaatcagctttcgtagacaaggaatagagtctctctcaagagagttgattttgttag

SEQ ID NO: 520 - protein, 563 aa, Oryza sativa
  misc_feature (83)..(83): Xaa = any naturally occuring amino acid
  misc_feature (256)..(256): Xaa = any naturally occuring amino acid
  misc_feature (378)..(378): Xaa = any naturally occuring amino acid
MESIAAATFTPSRLAARPATPAAAAAPVRARAAVAAGGRRRTSRRGGVRCSAGKPEASAVINGSAAARAAEEDRRRFFEAAEXGSGKGNLVPMWECIVSDHLTPVLAYRCLVPEDNMETPSFLFESVEQGPEGTTNVVRPSGRYSMVGAHPVMEVVAKEHKVTIMDHEKGKVTEQVVDDPMQIPRSMMEGWHPQQIDQLPDSFPGGWVGFFSYDTVRYVEKKKLPFSGAPQDDRNLPDVHLGLYDDVLVFDNVEKXKVYVIHWVNLDRHATTEDAFQDGKSRLNLLLSKVHNSNVPKLSPGFVKLHTRQFGTPLNKSTMTSDEYKNAVMQAKEHIMAGDIFQIVLSQRFERRTYANPFEVYRALRIVNPSPYMAYVQXARGCVLVASSPEILTRVRKRVSKPGSVKVEKLMNIERYSHVMHISSTGSGELDDHLQSWDALRAALPVGTVSGAPKRVKAMELIDELEVTRRGPYSGGLGGISFDGDMLIALALRTIVFSTAPSHNTMYSYKDTERRREWVAHLQAGAGIVADSSPDDEQRECENKAAALARAIDLAESAFVDKE

SEQ ID NO: 521 - DNA, 363 bp, Oryza sativa
  misc_feature (58)..(58): y = cytosine or thymine
  misc_feature (73)..(73): y = cytosine or thymine
  misc_feature (194)..(194): r = adenine or guanine
  misc_feature (197)..(197): m = adenine or cytosine
  misc_feature (282)..(282): s = guanine or cytosine
atggagatcggtggcgtgctcgtgtcgctgctcttcgcgccttctccctggctgcctyctctcctcctcgtcytcgccgaggcggcctcgctcgcctccctcgcgctccgcggcggccgctacgcctggcccacccgctccgacttcctcggctaccgcatcgcccgccgccgccgcgccgccttctccgccgrcgmcgcggggcggacggcgaggaggaggcgcagccgacggcggaatgctgcgaccgccttgccgtggcgatgtaccggcgcgggcgcsacgcggctcccgtggactgcgtgttctgcctgtcgcgggtggacgacggcgaggaggggttttttagtagttaattgctaa

SEQ ID NO: 522 - protein, 120 aa, Oryza sativa
MEIGGVLVSLLFAPSPWLPPLLLVLAEAASLASLALRGGRYAWPTRSDFLGYRIARRRRAAFSAADAGRTARRRRSRRRNAATALPWRCTGAGATRLPWTACSACRGWTTARRGFLVVNC

SEQ ID NO: 523 - DNA, 941 bp, Oryza sativa
atggtggttccggtgatcaacttctccaagctcgacggcaccgccgcggagagggccgagacgatggcgcagatcgacaatggctgcgaggagtggggattcttccagcagctggtgaaccatggcgtcccgaaggagcttcttgatcgggtgaagaaggtgtgctcggagagctaccgactccgggaggcggcgttcatggagtcgagccggtgaggacgctggaggggctcatggcggcggagcggcgcggcgaggcggcggcgccggtggacgacatggactgggaggacatcttctacctccacgacgacaaccagtggccgtcgaaaccgccggagttcaaggagacgatgcgggagtaccgcgcggcgctgcgggggctcgccgagagggtgatggaggccatggacgagaacctcggcctcgacaaggggcgcatgaggcgcgccttcaccggcgacggccgccacgcgccgttcttcggcaccaaggtcagccactacccgccgtgcccgcgccccgacctcatcaccggcctccgcgcccacaccgacgccggcggcgtcatcctgctgttccaggacgaccgcgtcggcggcctccaggtgctcaggggcggcgagtgggtcgacgtgcagccgctcgccgacgccatcgtcgtcaacaccggcaaccaggtggaggtgctcagcaacggccgctaacgcagcgcgtggcaccgcgtcctccccatgcgcgacggcaaccggcgctccgtcgcgtccttctacaacccggccttcgaggcgaccatctcgccgacggtggagggcggcgccggcgccggcggcgagtacccggagtacgtgttcggggagtacatggatgtgtacgccaagcaaaagttcgatgcgaaggagccacgcttcgaggcagtcaaggcgccaaaatctgcttaa

SEQ ID NO: 524 - protein, 315 aa, Oryza sativa
  misc_feature (72)..(72): Xaa = any naturally occuring amino acid
  misc_feature (236)..(236): Xaa = any naturally occuring amino acid
  misc_feature (268)..(269): Xaa = any naturally occuring amino acid
MVVPVINFSKLDGTAAERAETMAQIDNGCEEWGFFQQLVNHGVPKELLDRVKKVCSESYRLREAAFMESSRXGRWRGSWRRSGAARRRRRWTTWTGRTSSTSTDDNQWPSKPPEFKETMREYRAALRGLAERVMEAMDENLGLDKGRMRRAFTGDGRHAPFFGTKVSHYPPCPRPDLITGLRAHTDAGGVILLFQDDRVGGLQVLRGGEWVDVQPLADAIVVNTGNQVEVLSNGRXRSAWHRVLPMRDGNRRSVASFYNPAFEATISXXPTVEGGAGAGGEYPEYVFGEYMDVYAKQKFDAKEPRFEAVKAPKSA

SEQ ID NO: 525 - DNA, 177 bp, Oryza sativa
atggatgtagcaactgcatgccctcaggtgtatatagaaatagggatttcccagacaggcacaagggatggaaagaggcctccggctgtggggcatccctccaaagggagggcggtcgtcatcaacgcacaccacaccgtcggacctgcctctgtgcgtgcaccaccgctgccgtga

SEQ ID NO: 526 - protein, 58 aa, Oryza sativa
MDVATACPQVYIEIGISQTGTRDGKRPPAVGHPSKGRAVVINAHHTVGPASVRAPPLP

SEQ ID NO: 527 - DNA, 156 bp, Oryza sativa
atgcaaatgctgatgagcgtctttgtcattatcattggttgctacactgctattggctggatcaccgacatcgtcatcttcatcatgtcggttgcgtttgtcgtcgtcaactacacaactttatcgctgagcgccttcatattcattgctggctga

SEQ ID NO: 528 - protein, 51 aa, Oryza sativa
MQMLMSVFVIIIGCYTAIGWITDIVIFIMSVAFVVVNYTTLSLSAFIFIAG

SEQ ID NO: 529 - DNA, 1572 bp, Oryza sativa
atggccatgtcgtcgcgaagcttaggcgccctagccgccttcgtcttcctctgctcagctgcctccatgtcgtcctccatggccgccacggacagcttcctccaatgcctctcggcgagcatacccagccagctcctgtacacgcagagctcgccgtcgtacacgtcggtgctggacgccggcatccggaaccctaagttcctgacgaacaccacgcggccggtctggatcatcacgccgacgaacgcctcccacgtccaggccgccgtgctctgcggccgccggaacggcgtccgcctccgcatccgcagcggcgggcacgactacgagggcctctcgtacaggtcggagcggccggagacgttcgccgtgctcgacctcgtcaacatccgcgccgtccgcgtcgacgcggcgtccgccaccgcgtgggtggactccggcgcgacgctcggggagatgtactacgccatcgggaaggccggcggccggatcgcgttcccggccggcctgtgtccgaccgtcggcgtcggcggccacttcagcggcggcggcttcggcatgctgctccgcaagtacggcctcgccgccgacaacgtcgtcgacgccgtcctcgtggacgccaagggcaggctcctcgacaagaactccatgggcagcgacgtcttctgggcgctccgcggcggcgccggcgagagcttcgggatcgtgctctcctggaaggtgaagctcgtggccgtgccgccgaccgtcacggtgttcaacgtcccggtgaccgtgagccagggcgccatcgacgtcgtcacgaggtggcaggccgtcgcgccgtcgctccccgacgacctgttcatccgcgtgctcgtccagggccagagggccagcttccagtccctctacctcggcacctgcgacgcgctgctgccggtgatgcgcagccgcttcccggagctcggcatgaaccggtcggactgcagggagatgacttggatccagtccgtcccctacatctacctcggcagcagcgccaccgtggaggacatcctgaaccggaccatcgccatggacacctccaacaaggccacctccgactacgtccggcaagccatcggcagggacacgtggagcgccatcttcgggtggctcgcgcggcccaacgccgggctgatgatcctggacccgtacggcgggcagatcggcagcgtggcggaggcggcgacgccgttcccgcaccgcggcggcgtgctctacaacatccagtacatgaacttctggagcgcggcgggcggaggcggcggcggcgcggcgcagagggcgtggatcagggacttctacgcgttcatggcgccgttcgtgagcaaggacccgagggaggcgtacgccaactacagggacctggacctcggcgagaacgtggtcggcgccggcggcgtcagcagctacgacgccggcaaggtgtggggggagaagtacttcagggggaactaccagcggctcgccatggccaaggcgcagatcgacgccgacgactacttcaggaacgagcagagcatcccgccacttgtcgccggaaaatga

SEQ ID NO: 530 - protein, 523 aa, Oryza sativa
MAMSSRSLGALAAFVFLCSAASMSSSMAATDSFLQCLSASIPSQLLYTQSSPSYTSVLDAGIRNPKFLTNTTRPVWIITPTNASHVQAAVLCGRRNGVRLRIRSGGHDYEGLSYRSERPETFAVLDLVNIRAVRVDAASATAWVDSGATLGEMYYAIGKAGGRIAFPAGLCPTVGVGGHFSGGGFGMLLRKYGLAADNVVDAVLVDAKGRLLDKNSMGSDVFWALRGGAGESFGIVLSWKVKLVAVPPTVTVFNVPVTVSQGAIDVVTRWQAVAPSLPDDLFIRVLVQGQRASFQSLYLGTCDALLPVMRSRFPELGMNRSDCREMTWIQSVPYIYLGSSATVEDILNRTIAMDTSNKATSDYVRQAIGRDTWSAIFGWLARPNAGLMILDPYGGQIGSVAEAATPFPHRGGVLYNIQYMNFWSAAGGGGGGAAQRAWIRDFYAFMAPFVSKDPREAYANYRDLDLGENVVGAGGVSSYDAGKVWGEKYFRGNYQRLAMAKAQIDADDYFRNEQSIPPLVAGK

SEQ ID NO: 531 - DNA, 744 bp, Oryza sativa
  misc_feature (240)..(240): k = guanine or thymine
  misc_feature (456)..(456): r = adenine or guanine
  misc_feature (510)..(510): k = guanine or thymine
atggcggtggaggcggttcttgaggcgtcgagaagtagtagtgaggaggaggcggaggtgatcgtcacgcacggcggcggcggcggcggcggaggaggaggaggacaggtggaggggtgggggaagcggaagcggtcgcggcggcggcgaccgcagctgccgccctccgaggaggagtacctcgcgctctgcctcctcatgctggcgcgcgggcgacgcgacggcgacgacgtggcggcktcggcgtcggcggcggcggcggcggtggagcaccggtgctccgtctgcggcaaggcgttcgcgtcctaccaggctctcggcggccacaaggccagccaccggaagccgccgccgcccgccatggtcgacgacgacgaggtggtggtggagacgaaaccggcggctatcgcgacgccgtcctcgtcggcgtcgggcgtctccggcggcggcggcggragggcgcacgagtgcaacgtgtgcggcaaggcgttcccgacggggcaagcgctkggcggccacaagcgatgccactacgacggcacgatcggcagcgccgccggcgccggcgcgtccaagccggcggcgaagacgaccgtggcggtggcggcgagccggggcttcgacctcaacctgccggcgctgccggacgtcgccgccgccgccgaccagcggtgcgcggcggaggacgacgaggtgctcagccctctcgccttcaagaagcccaggctcatgatcccggcatag

SEQ ID NO: 532 - protein, 247 aa, Oryza sativa
MAVEAVLEASRSSSEEEAEVIVTHGGGGGGGGGGGQVEGWGKRKRSRRRRPQLPPSEEEYLALCLLMLARGRRDGDDVAASASAAAAAVEHRCSVCGKAFASYQALGGHKASHRKPPPPAMVDDDEVVVETKPAAIATPSSSASGVSGGGGGRAHECNVCGKAFPTGQALGGHKRCHYDGTIGSAAGAGASKPAAKTTVAVAASRGFDLNLPALPDVAAAADQRCAAEDDEVLSPLAFKKPRLMIPA

SEQ ID NO: 533 - DNA, 417 bp, Oryza sativa
atggctgtggtgcgaagggcgaagcggcgacggtggcaatgcggggcgaagggggtgttccgacagtggtggtgcgtggccaccatggtggaggcgaggtgggctccagctctatataaattggagttgggagctggagctgggccaaacggagccttaaggggtaaagatttgtggatgtcaaacaatctcggcttaaaagtggaggcacggcgagtgaacgtccgccgtgtttgccccctcgcgtatcctttcctctttcttgctgccgtatcgaaacaacctcaagatatggttggcgaccttgtgctagaagattggaatgaagctgctggttgtgtgcttttgcctgaaaaatctgttgcctcttgggctgctctcccagatgctcagctttgttgggcacatctctgttag

SEQ ID NO: 534 - protein, 138 aa, Oryza sativa
MAVVRRAKRRRWQCGAKGVFRQWWCVATMVEARWAPALYKLELGAGAGPNGALRGKDLWMSNNLGLKVEARRVNVRRVCPLAYPFLFLAAVSKQPQDMVGDLVLEDWNEAAGCVLLPEKSVASWAALPDAQLCWAHLC

SEQ ID NO: 535 - DNA, 390 bp, Oryza sativa
atggcggtaaagacttgcataggagatggacaatccaccttgtgttggatggatagatggctggaagggaaaactgttagtgagatagctcctaatttgactaagttgatagccaaaaatactgttaggcggtgtacggtggtacaagccttggacaacaaaaaatgggtaacagatattaacggaccattgatggttcagcggaccggttggacaatatggtgtttggtcctgaaacggcttggttactctagctttccaacccaggttactgctaggagtactaattgggtggtcaataacgccatcgctaatgagggcgctatttggtgcctagcaggagctgctaggctccgtgatctctttagggctgggctgttaatgcactag

SEQ ID NO: 536 - protein, 129 aa, Oryza sativa
MAVKTCIGDGQSTLCWMDRWLEGKTVSEIAPNLTKLIAKNTVRRCTVVQALDNKKWVTDINGPLMVQRTGWTIWCLVLKRLGYSSFPTQVTARSTNWVVNNAIANEGAIWCLAGAARLRDLFRAGLLMH

SEQ ID NO: 537 - DNA, 1047 bp, Oryza sativa
  misc_feature (978)..(978): r = adenine or guanine
atggcggcggaggccgctgccggcgacggtgcggacggcggcggaggccgcggcgggcgacggcggttgcatgcgacgacgtcggcgctgtggactatggccggcaacgagataggaggagaatacgcgtggggtgtttggtcccggtcagccatggcggatcagttcgcggactctgcgaacaatgtagtcattgaggaggtcaacaagggactgaaccctggaatgatagtcctgattgtggtcgcgaccttcctgctgcttttctttgtcgggaactacgctctctatgtgtacgctcagaagacgcttcctcctcgcaaaaagaagccagtctcgaagaagaagatgaagagggaaaaactgaagcaagagcaacagttcgttactgctctgcctcagctcggctgcatctctcggcatccaccgatcggaccggccacctcacatctccccgtcgccgccgaagcctgcacgcgtcgtcgcccacattttcccactttccacggcgaactgacggcgacgccgcggccggcgcagcttggggaggtggatcagccgatgcagatggtgctgcgggtgaagcacccgtcgtcgctgggcggcggcggcggcggcggggaggaggaggccggcgaggcgtcgtcgaggtcggcgctgtcggtgttcaaggccaaggaggagcagatcgagaggaagaagatggaggtgagggagaaggtgttcgcgcagctcggccgcgtcgaggaggagtccaagcgccttgccttcatccgacaggaactggaagggatggcggatccaaccaggaaggaggtggaggtgatcaggaagaggatcgacgtggtgaaccgtcagctcaagcctctcggcaaaacctgcgtcaagaaggagaaggaatacaaagaaatcctggaggcgtacaacgagaagaacaaggagaaggcactgcttgtaaacaggctaattgagctggtragcgaaagtgagaggatgcgtatgaagaagctcgaggagctgaacaagacggtcgattcactctactag

SEQ ID NO: 538 - protein, 348 aa, Oryza sativa
MAAEAAAGDGADGGGGRGGRRRLHATTSALWTMAGNEIGGEYAWGVWSRSAMADQFADSANNVVIEEVNKGLNPGMIVLIVVATFLLLFFVGNYALYVYAQKTLPPRKKKPVSKKKMKREKLKQEQQFVTALPQLGCISRHPPIGPATSHLPVAAEACTRRRPHFPTFHGELTATPRPAQLGEVDQPMQMVLRVKHPSSLGGGGGGGEEEAGEASSRSALSVFKAKEEQIERKKMEVREKVFAQLGRVEEESKRLAFIRQELEGMADPTRKEVEVIRKRIDVVNRQLKPLGKTCVKKEKEYKEILEAYNEKNKEKALLVNRLIELVSESERMRMKKLEELNKTVDSLY

SEQ ID NO: 539 - DNA, 405 bp, Oryza sativa
atggcagcagggagctcactagctggcctagcgacgatggcgtgcgttccctcctttcacctggtatcagatcttggtatctggctaccagggctgatacttgtgggtatcagtcgtgattccccgagccacggcaaatggcaacctcaccaccgcagttaccttcctccttgccaacttgatcgattccatcaaccatataacctcgttggactccacatgcccaataaatgcggtgtagggaaggcgaagagaatgggacatgccatcagtgttagggatgatggcggtcggtcctctggcgaagggagtcggacccattcgattcgatcaaacaatttatggcccctagtggcttcgcttgcaatgccaaccagtggaggtcgaaaagaagaaaccccttag

SEQ ID NO: 540 - protein, 134 aa, Oryza sativa
MAAGSSLAGLATMACVPSFHLVSDLGIWLPGLILVGISRDSPSHGKWQPHHRSYLPPCQLDRFHQPYNLVGLHMPNKCGVGKAKRMGHAISVRDDGGRSSGEGSRTHSIRSNNLWPLVASLAMPTSGGRKEETP

SEQ ID NO: 541 - DNA, 1728 bp, Oryza sativa
atggacgccggcgacgccatggagagaggccagcagcggctgccagagagctggaacccgaaactccaggacgacgtcagcctgacggtgccactcatccaggacaagaagagcgggagcaaagcgccggcggtggtgctaggattcgagtgcttggagagcacagcgttcaacggcattgccacgaacctggtggtgtacctggagaccgtcctgcacggcagcagcctcgcgagcgcgtccaatgtcacgacgtggttcggcacgagctacctcacgccggtgttcggcgccatcatcgccgacacgttcttcggcaactacaacaccatcctcgtctccctcgtgttctacctcctgggcatggtgctggtcaccttctcggcgttcctgccgaccaccgcgctgtgcgccgtggcgggctcgacgtcgtgccagcagcctgtgtttggcgcgcagaccatcgccttcgtggggctctacctcgtggcgttcggcagcggcggcgtgcgcgcggcgctgctgccgttcggcgcggagcagttcgacgacgacaacgcggtggaccgggagcggaagatgtccttcttcagctggttctacatgtgcgtcgacttcgggatgatcgtgtcgggcctattcatcgtgtggatccagcagaacgtgagctggggactcggcttcggcatcgccacggtttgcgtcgcgatcgcgttcggcggcttcgtgctcgccacgcccatgtacaagcgcagcatgcccaccggcacgccgctcaagagcctcgcccaggtggtggtcgccgcgtgccggaaggtcagcctccgtgtccccgccgacgccgccctcctctacgaggtccatgacaagatcgatcagcccaagatcacgcacaccgacgagttcagctttcttgacaaggcggcggtgatcgtgcagtccgacctggaagaggactcgaacgacgcctcggcggcggccgcgggctcgtggaggctatgcacggtgacgcaggtggaggagctcaagatcctgatgcggctgctgccgatatgggcgacgagcatcgtgctgtcggcggcgtacgcgcagctgaacaccacgttcgtgcagcagggcgccgcgatgaacatgcggatcatgtcgttcaccatccccgccgcgtcgatggtgtccttcgaggtgttctgcgtcctggcatgggtgctcgtctacggctcggtgatcgtgccgctcctcaggagcttctccccggccaacggcgagccgtcgcagctgcggcgcatgggcgccggccgtctgctcatcgcggtcgccatggccatcgccgcgctggtggagatggtgcgcctcgacgcggcggcgcgcggcgagtccctgagcatcgcgtggcagatgccgcagtacttcatgctggccggcggtgaggtgttctgctacatcgcgcagctggagttcttctacagcgaggcgccggagtccatgaagagcatctgcacgtcgctggcgctgctcaccgtggcgctgggaagctacatgagctccttcatctacgccgtcgtgaacgcgttcaccgccgtggacggccggcccgggtggatttcggacaacctcaacgagggacacctggactacttcttctgggtcatgtcggcgctgtgcacgctcaacttcgtcgtgtacagcgcgttcgcgcggaactacaaggtgaagacggtcgtgtcatga

SEQ ID NO: 542 - protein, 575 aa, Oryza sativa
MDAGDAMERGQQRLPESWNPKLQDDVSLTVPLIQDKKSGSKAPAVVLGFECLESTAFNGIATNLVVYLETVLHGSSLASASNVTTWFGTSYLTPVFGAIIADTFFGNYNTILVSLVFYLLGMVLVTFSAFLPTTALCAVAGSTSCQQPVFGAQTIAFVGLYLVAFGSGGVRAALLPFGAEQFDDDNAVDRERKMSFFSWFYMCVDFGMIVSGLFIVWIQQNVSWGLGFGIATVCVAIAFGGFVLATPMYKRSMPTGTPLKSLAQVVVAACRKVSLRVPADAALLYEVHDKIDQPKITHTDEFSFLDKAAVIVQSDLEEDSNDASAAAAGSWRLCTVTQVEELKILMRLLPIWATSIVLSAAYAQLNTTFVQQGAAMNMRIMSFTIPAASMVSFEVFCVLAWVLVYGSVIVPLLRSFSPANGEPSQLRRMGAGRLLIAVAMAIAALVEMVRLDAAARGESLSIAWQMPQYFMLAGGEVFCYIAQLEFFYSEAPESMKSICTSLALLTVALGSYMSSFIYAVVNAFTAVDGRPGWISDNLNEGHLDYFFWVMSALCTLNFVVYSAFARNYKVKTVVS

SEQ ID NO: 543 - DNA, 147 bp, Oryza sativa
atggacgattcactggccagctcgcttgcagatgactcttcagaacgacttgactctgtggaggcggaggaggtggacgcggaggaggtggagggggaggtggaggtggaggtggaggaggtgggggtggcggaggcatcagtttag

SEQ ID NO: 544 - protein, 48 aa, Oryza sativa
MDDSLASSLADDSSERLDSVEAEEVDAEEVEGEVEVEVEEVGVAEASV

SEQ ID NO: 545 - DNA, 423 bp, Oryza sativa
atgcggaaatatcgagtcgccggattggtagccgccctgctcgtgctgcattcgctagccacgccgtccgctcaggccgaggcgcatcgcgcagggggagaaggggaggagaagatgtcgagcgacggagggccggtgcttggcggcgtcgagccggtggggaacgagaacgacctccacctcgtcgacctcgcccgcttcgccgtcaccgagcacaacaagaaggccaattctctgctggagttcgagaagcttgtgagtgtgaagcagcaagttgtcgctggcactttgtactatttcacaattgaggtgaaggaaggggatgccaagaagctctatgaagctaaggtctgggagaaaccatggatggacttcaaggagctccaggagttcaagcctgtcgatgccagtgcaaatgcctaa

SEQ ID NO: 546 - protein, 140 aa, Oryza sativa
MRKYRVAGLVAALLVLHSLATPSAQAEAHRAGGEGEEKMSSDGGPVLGGVEPVGNENDLHLVDLARFAVTEHNKKANSLLEFEKLVSVKQQVVAGTLYYFTIEVKEGDAKKLYEAKVWEKPWMDFKELQEFKPVDASANA

SEQ ID NO: 547 - DNA, 339 bp, Oryza sativa
atggcgccgccgcagcccaagtcggggctcttcgtcggcatcaacaagggccacgtcgtcaccaagcgcgagctgccacctcgcccgtccgaccgcaaggggtttgtcaggggcttgattagggaggttgtgggatttgctccatatgagaaacgaatcactgagcttctgaaggttggaaaggacaagcgtgcactgaaggtcgctaagagaaagctcggtacccacaagagagcaaagaagaagagagaggagatggcgggtgtcatcaggaagatgaggtgtgtgtctttactactgcattctgcaatttcattgttgatgttctctgttttttag

SEQ ID NO: 548 - protein, 101 aa, Oryza sativa
  misc_feature (35)..(41): Xaa = any naturally occuring amino acid
  misc_feature (76)..(77): Xaa = any naturally occuring amino acid
MAPPQPKSGLFVGINKGHVVTKRELPPRPSDRKGXXXXXXXFVRGLIREVVGFAPYEKRITELLKVGKDKRALKVXXEKARYPQESKEEERGDGGCHQEDE

SEQ ID NO: 549 - DNA, 297 bp, Oryza sativa
atggatcttctgaacaatgtctccaaggaggaaaacaacgccaagagcgccgccgccgcctgtcctaaagaatcaagacatgggtttcacctgaagaaaccattgtgggaggggaaaaaatgctcgccaccacaccgctccagcctccacgccggcctcatcacctcgcgtcatcggccttctacctacgcattgcggccttcacctcgagacgtcagcatcctcctcatgcaccgccagccacagctccacatatcactgcccatgcggcactcctgcacgtcgcacctctactga

SEQ ID NO: 550 - protein, 98 aa, Oryza sativa
MDLLNNVSKEENNAKSAAAACPKESRHGFHLKKPLWEGKKCSPPHRSSLHAGLITSRHRPSTYALRPSPRDVSILLMHRQPQLHISLPMRHSCTSHLY

SEQ ID NO: 551 - DNA, 393 bp, Oryza sativa
atgcctaaggtgacttcggttgttatggcagccgtggtaggcctggcgatggtgtctctggtcgctggcatctctggcactgcgactttctacacgcctccttacacgccatcggcgtgcttcgggttccaggagcaggggacgatgatcgcggcggcgagcgacgtgttctggaacggcggggcggcgtgcgggaagcggtacgtggtgacgtgcacgggcgccaccaaccagggggtgccgcggccgtgcaccggccggagcgtcaccgtgaagatcgtcgaccactgcccctccggctgccagggcaccatcgacctctcccaggaggccttcgccatcatcgccaaccccgacgccggcaagatcaagatcgactaccgccaggtgtaa

SEQ ID NO: 552 - protein, 130 aa, Oryza sativa
MPKVTSVVMAAVVGLAMVSLVAGISGTATFYTPPYTPSACFGFQEQGTMIAAASDVFWNGGAACGKRYVVTCTGATNQGVPRPCTGRSVTVKIVDHCPSGCQGTIDLSQEAFAIIANPDAGKIKIDYRQV

SEQ ID NO: 553 - DNA, 348 bp, Oryza sativa
atggttttgagagtcatgctcatgacaattaaggaccggttcgcgagctacttttgtgaaacattaaccgtgccaaccacaagccagcgtgggcaatggctttaccttttgtatagcatgggtgattatgatccaggaaaggtgcgctgtggtggattgtgttctgcgaggggtactgtcacagctcctttccaaggtaccgtggtggtattgaggcgcatggtgacatgctgtggggctgtgtcttgtgggtacagtgctcctggtttggagttagatctgtatagccgggtatggttgttcaggatggttgggcctgtgcagcatgggtgtgctgttcagtgttga

SEQ ID NO: 554 - protein, 115 aa, Oryza sativa
MVLRVMLMTIKDRFASYFCETLTVPTTSQRGQWLYLLYSMGDYDPGKVRCGGLCSARGTVTAPFQGTVVVLRRMVTCCGAVSCGYSAPGLELDLYSRVWLFRMVGPVQHGCAVQC

SEQ ID NO: 555 - DNA, 210 bp, Oryza sativa
atggacgccacggcgtacacgcgcatcttggagaacatcgtcaccttcttgaggttcttggccgagaccagcgtcacctccagcacccggcgcgccatcgccgccgcggcgaacagccggccggacgatgcacgcagggtggttaattgcaaacaagagcacaaaggtcatttctctgttggtttcacctccattgctgtggcaatgtga

SEQ ID NO: 556 - protein, 69 aa, Oryza sativa
MDATAYTRILENIVTFLRFLAETSVTSSTRRAIAAAANSRPDDARRVVNCKQEHKGHFSVGFTSIAVAM

SEQ ID NO: 557 - DNA, 312 bp, Oryza sativa
atggggctgtacgtcgactcaagtgataagcctgcctgccagccattaagtcaagtgactggacggagggagtgctgtactgtcctagtagatttgatttatacgggacgaatggagtacgtgcagctttgcttgttctgtccaaattacatcgtgaattattacgcaggaggactcgttgattgcgaactcacggcacatccggcggtcgccacagtgccgtacggctgggttggccgaccaccgaaaggtgcgggaaggagagctgtctgcgttctactccggtactcacccgacaaaaaccaaacttag

SEQ ID NO: 558 - protein, 103 aa, Oryza sativa
MGLYVDSSDKPACQPLSQVTGRRECCTVLVDLIYTGRMEYVQLCLFCPNYIVNYYAGGLVDCELTAHPAVATVPYGWVGRPPKGAGRRAVCVLLRYSPDKNQT

SEQ ID NO: 559 - DNA, 435 bp, Oryza sativa
atggcggccgccgacgtggcgtacgcgccgccgatgaagtccggcaagatcggcttcgagagctcgcaggaggtgcagcacaggatccgcatcaccctctcctccaagagcgtcaagaacctcgagaaaggtctgcggtgatctggtgaagggagccaaggacaagagcttgaaggtgaagggccccgtgcggatgcccaccaaggtgctccacatcaccaccaggaagtctccttgtggagaagaggtaccaacacctgggatcggtttgagatgcgggtgcacaaaagggtgattgatcttgtcagctctgcagatgttgtcaagcagatcacctcaatcaccattgagccaggtgtggaggttgaagtgaccatcagcgaccagtaaaatgctgctatccaacaggtggagaaattcggtgaacagggtagg

SEQ ID NO: 560 - protein, 129 aa, Oryza sativa
  misc_feature (82)..(82): Xaa = any naturally occuring amino acid
MAAADVAYAPPMKSGKIGFESSQEVQHRIRITLSSKSVKNLEKVCGDLVKGAKDKSLKVKGPVRMPTKVLHITTRKSPCGEXGTNTWDRFEMRVHKRVIDLVSSADVVKQITSITIEPGVEVEVTISDQ

SEQ ID NO: 561 - DNA, 2015 bp, Oryza sativa
  misc_feature (336)..(336): s = guanine or cytosine
  misc_feature (375)..(375): y = cytosine or thymine
  misc_feature (444)..(444): s = guanine or cytosine
  misc_feature (450)..(450): m = adenine or cytosine
  misc_feature (472)..(472): k = guanine or thymine
  misc_feature (486)..(486): s = guanine or cytosine
atggcggccgtcgatacgccggagaagccgtacgagggtaagccggcggcggaggcgaggagctactggcggtggcagaaggaagatttcttcccggagccgtccttcgcgagctggggcgcgtaccgcgcggcgctggccgcgaagcccgcgcggttccgcgaccgcttcgccggccgctccaccgacgccgacgagctcggcgcgctgcgccgccgcagcgagaacgagatgcgccgctgcctcacgtggtgggacctcacgtggttcgggttcggctccgtcatcggtgccgggatcttcgtgctcaccggccaggaggcgcacgaccacgcsggcccggccatcgtgctctcctacgtggcctccggcttytccgccatgctgtccgtgttctgctacacggagttcgccgtcgagatccccgtggccggcggctccttsgcctamctccgcgtcgagctcggcgacktggcggccttcatsgccgccgcgaacctcatcctcgagagcatcatcggcacggccgcggtggcgcgctcctggacgtcgtacctcgcgtcgctcatcaacaagccggcgagcgcgctgcgcatacagacgtcgctcgccgaggggtacaacgagctggaccccatcgcggtggtggtgatcgcggtcacggcgaccctggccattctgagcgccaagggcacctcccgcgtcaactgggtcgcctccgccgtgcacgtcctcgtgatagccttcgtcatcgtggccggcttcctccacgcgaagaccagcaacctgaccccgttcatgccgcacggcgtgccgggcgtgttccgcgcggcggcgatcgtctacttcgcctacggcgggttcgacaacatcgcgaccatggcggaggagaccaagaacccatcgagagacatccctctcgggcttctcggctccatgtcggtgatcacggccatctactgcgtgatggcgctggtgctgagcatgatgcagccgtacacggcgatcgaccggagcgcggcgtactcggtggcgttcagcaacgtcgggatgcggtgggcgcagtacgtggtggcgctcggcgcgctcaaggggatgacgacggtgctgctggtcggggcgctcggtcaggctcggtacaccacgcacatcgcgcgcagccacatcatcccgccggtgttcgcgctggtgcaccccaggaccggcacgccggtgcacgccaccgtgctcatcgccgccgccggcgcctgcatcggcctcttctccagcctcgacgtgctctccagcctcctctccgtcagcacgctcttcatcttcatgatgatggccaccgccctcctcgtccgccgcgcaggtactacgtgcggggcgtgacgagcaggacgcacgcgaggcggctggtggcgttgctatcggtggtcatcggctcgtcggcgggcatcgcggcgtactggggcgcggcgccggagcggtgggttgggtacaccgtgctggtgccggcgtgggcggcgggcacgctcggcatccagcttctggtgccggcggcgcgcgcgcccaaggtttggggcgtgccgctcgtgccgtggctgccgtcgctgtccatcgccaccaacctcttcctcatgggctcgctcggcgcgcaggcgttcatccgcttcggcgtctgcaccgccatcatgctgctctactacgtgctcgtcgggctgcacgccacctacgacgtcgcgcacggcgcgtgctccggcgacgacgtcgacgaggaggtctacgctgatgccgcccacgtggacgatgcgaaggcggcggccgcggtcgctgccaacgcagacgtggagagggcgggcgcgaagatctgatcacatgcctaatgatttggtacattgatgcgaagaatattcaaaactgtagcgtgcaactgcaaatatcattatctattgaacagtatctcaccaaagtgggaaatggattctctttggagggatagggatatcccctccgtctgtcgtgtcatgtaa

SEQ ID NO: 562 - protein, 625 aa, Oryza sativa
  misc_feature (148)..(148): Xaa = any naturally occuring amino acid
  misc_feature (150)..(150): Xaa = any naturally occuring amino acid
  misc_feature (158)..(158): Xaa = any naturally occuring amino acid
  misc_feature (162)..(162): Xaa = any naturally occuring amino acid
  misc_feature (195)..(198): Xaa = any naturally occuring amino acid
  misc_feature (221)..(221): Xaa = any naturally occuring amino acid
  misc_feature (231)..(231): Xaa = any naturally occuring amino acid
  misc_feature (238)..(238): Xaa = any naturally occuring amino acid
  misc_feature (261)..(264): Xaa = any naturally occuring amino acid
MAAVDTPEKPYEGKPAAEARSYWRWQKEDFFPEPSFASWGAYRAALAAKPARFRDRFAGRSTDADELGALRRRSENEMRRCLTWWDLTWFGFGSVIGAGIFVLTGQEAHDHAGPAIVLSYVASGFSAMLSVFCYTEFAVEIPVAGGSXAXLRVELGDXAAFXAAANLILESIIGTAAVARSWTSYLASLSTSRRXXXXARCAYRRRSPRGTTSWTPSRWWXSRSRRPWPFXAPRAPPXVNWVASAVHVLVIAFVIVAGFLXXXXHAKTSNLTPFMPHGVPGVFRAAAIVYFAYGGFDNIATMAEETKNPSRDIPLGLLGSMSVITAIYCVMALVLSMMQPYTAIDRSAAYSVAFSNVGMRWAQYVVALGALKGMTTVLLVGALGQARYTTHIARSHIIPPVFALVHPRTGTPVHATVLIAAAGACIGLFSSLDVLSSLLSVSTLFIFMMMATALLVRRRYYVRGVTSRTHARRLVALLSVVIGSSAGIAAYWGAAPERWVGYTVLVPAWAAGTLGIQLLVPAARAPKVWGVPLVPWLPSLSIATNLFLMGSLGAQAFIRFGVCTAIMLLYYVLVGLHATYDVAHGACSGDDVDEEVYADAAHVDDAKAAAAVAANADVERAGAKI

SEQ ID NO: 563 - DNA, 573 bp, Oryza sativa
atgggagacaatcttgatgaagtcatcgacaagcgcttgaaagcattggaagaaatagagaaagagaagaagagggtggccaaggcgtacaacaaaagggtgaaagcaaagttgtttcaagttggagacttggtttggaagataattatgcctttgggtactcgatccaaggagttcgaaaagagaaaaaaatgtttcagggagaaaaaaaaacagaaaaaagaaagagagaaagatcaggaggagggagggggagcgagagagatcgggaggagggaggggaatcagcagagagaggggggaacaggagggagagaggggaggagggaggggaagcaggagagagaggggggaacaggagggagagagagaaaaaaaaacagaaaaaagaaagagagagagatcaggaggagggagggggagcgagagagatcgggaggagggaggggaagcaggagagagagtggggaagaggagggagagagaggggaggagggaggggaagcaggagagagaggggggaacaggagggagggagggatacggatgagaaagggagggggtatagaatag

SEQ ID NO: 564 - protein, 190 aa, Oryza sativa
MGDNLDEVIDKRLKALEEIEKEKKRVAKAYNKRVKAKLFQVGDLVWKIIMPLGTRSKEFEKRKKCFREKKKQKKEREKDQEEGGGAREIGRREGNQQREGGTGGREGRREGKQEREGGTGGRERKKNRKKKEREIRRREGERERSGGGRGSRRESGEEEGERGEEGGEAGERGGNRREGGIRMRKGGGIE

SEQ ID NO: 565 - DNA, 855 bp, Oryza sativa
atcgtgcattctgacgagtcgtacgtgcatcctgacacggcgtcgatcgttcgaatatataaacacagctgcgctctacgccaacaactaactgtccgtgtgcgagttgcgaccttgctggaaaacttgtacctagagctagctgaaggaagcaatatggccaccgtggatggcacaacggcgccgagctccggcggcaagacggcgacggtggcgttggagtcgggcggcggccgctacggtgggccggctccggcgaaatgctccggcgccaacctggccctgagggcgctgctcttcgccgtgtcgctgtccgcgctcgtggtgcttgtcaccgccaagcagacggtgatggtcccgttcgtcatccggccgccgcagttcatcctcgcgccggtccccgccaagtacacgcactcaccggcgctcatatatctgctggctgcgctgtgcgcgacgtgcttttacagcctgatcacggccatcagctcggtgaggttgctctccagctcggcttgctctgccaagacgctcttctacctcatcctgcttgatgtgggatggaatttttatatttctgaccaatttatttttgctcttgtgtgcaaattcgtggcagttctacgcagccgtgatggcgtcggcgaccgggacagcgggggccgtggcgtgggtgggactgaaggggaactcccacacccggtggaacaagatatgcaacgtctacggcaagttctgccgccacatcggcagctccaccttcctcgccctcatcgccgccatcgttctcgtcctcctcgccttcctcaacgcctactccctctaccgccgaagccgttgattcattccccatga

SEQ ID NO: 566 - protein, 284 aa, Oryza sativa
IVHSDESYVHPDTASIVRIYKHSCALRQQLTVRVRVATLLENLYLELAEGSNMATVDGTTAPSSGGKTATVALESGGGRYGGPAPAKCSGANLALRALLFAVSLSALVVLVTAKQTVMVPFVIRPPQFILAPVPAKYTHSPALIYLLAALCATCFYSLITAISSVRLLSSSACSAKTLFYLILLDVGWNFYISDQFIFALVCKFVAVLRSRDGVGDRDSGGRGVGGTEGELPHPVEQDMQRLRQVLPPHRQLHLPRPHRRHRSRPPRLPQRLLPLPPKPLIHSP

SEQ ID NO: 567 - DNA, 189 bp, Oryza sativa
atggccatggccggaggagagctcgagaggatatgggatctcgtcgcttggttggttgcactgcgtgccactgttcaccggggcccactgccttcgacagcgaggaaagattccgtgattctgactttggtgagagcgagacgaggatttggagtgttggacacttttgccgtgaggttgattggctga

SEQ ID NO: 568 - protein, 62 aa, Oryza sativa
MAMAGGELERIWDLVAWLVALRATVHRGPLPSTARKDSVILTLVRARRGFGVLDTFAVRLIG

SEQ ID NO: 569 - DNA, 2189 bp, Oryza sativa
atggagtgcgagaacgggcacgtcgccgccgccgccaacggcagcagcctgtgcgtggctaagccgcgtgccgacccgctcaactgggggaaggcggcggaggagctgtccgggagccatctggacgcggtgaagcgcatggtggaggagtaccgcaggcccgtggtgacgatcgagggcgccagcctgaccatcgcgcaggtcgcggcggtggcctccgccggcgccgccagggtggagctcgacgagtccgcccgcggccgcgtcaaggccagcagcgactgggtcatgaacagcatgatgaacggcaccgacagctacggcgtcaccaccggcttcggcgccacctcccaccggaggaccaaggagggcggcgcgctccagcgagagcttatccgaggtttcttaatgccggggcgttcggcaacggcgacgacggccacgtgctgccggccgcggcgacgcgggcagccatgctcgtccgcatcaacactctgctccaggggtactctggcatccggttcgagatcctcgagacgatcgccacgctgcttaacgccaacgtgacgccgtgcttgccgctccggggcacgatcaccgcgtccggcgacctcgtcccgctctcctacatcgcgggactcgtcaccggccgaccaaactctgtggcggtgacgcccgatggcaggaaggtggatgccgcggaggcgttcaagatcgccggcatccagcacggcttcttcgagctccagcccaaggaaggcctcgccatggtgaacggcacggccgtcggctccgggctcgcctcgatggtgctctttgaggcgaacgtccttggcgtgctcgcggaggtcctctccgcggtgttctgcgaggtcatgaacggcaagccggagtacaccgaccacctgacgcacaagcttaagcaccacccgggacagattgaggcagccgccattatggagcacatcttggaggggagctcctacatgatgctggcgaagaagctcggcgagctcgacccgctgatgaagcccaagcaagacaggtacgcgctccgcacgtcgccgcaatggctcggcccccagattgaggtcatccgtgccgccaccaagtcgatcgagcgcgagatcaactccgtcaacgacaacccgctcattgacgtctcccgtggcaaggcgctccacggcggcaacttccagggcacacccatcggcgtgtccatggacaacaccaggctcgccattgccgcgatcggtaagctcatgttcgcgcagttctctgagctcgtgaacgatttctacaacaacggcctgccgtccaacctgtccggtgggcgcaacccgagcttggactacggcttcaagggtgccgagatcgccatggcatcgtactgctctgagctccagttcttggccaaccctgtgaccaaccatgtccagagcgcggagcagcacaaccaagacgtcaactctctcggcctcatctcgtccaggaagacggccgaggccatcgacgtgctcaagctcatgtcctcgacgttcttgatcgcgctatgccaggccatcgacctgcgccacctcgaagagaacgtcaggagcgccgtcaagggctgcgtgacgacggtggcgaggaagaccctgagcaccagcgccaccggcgacctccacaaggcccggttctgcgagaaggacctgctccaggcgatcgaccgcgaggccgtgttcgcgtacgcggacgacccctgcagcgccaactacccgctgatgcagaagatgcgcgccgtcctcatcgagcacgcgctggccaacggcgaggcggagcgcaacgtcgacacctcggtgttcgccaaggtcgcgacgttcgaggaggagctccgcgtggcgctgcccagggaggtggaggctgcccgtgcggccgtggagaacggcaccgccgcaaaggcgaacaggatcaccgagtgcaggtcgtacccgctctaccggttcgtccgcgaggagctcgggacagagtacttgaccggggagaagacgcggtcgcccggcgaggaggtgaacaaggtgttcgtcgccatgaaccagggcaagcacatcgacgcactgcctcgagtgcctcaaggagtggaacggcgagcctctgcccatctgctgattgctgaacagaggaccgacgagaagatagcaaaatattag

SEQ ID NO: 570 - protein, 715 aa, Oryza sativa
MECENGHVAAAANGSSLCVAKPRADPLNWGKAAEELSGSHLDAVKRMVEEYRRPVVTIEGASLTIAQVAAVASAGAARVELDESARGRVKASSDWVMNSMMNGTDSYGVTTGFGATSHRRTKEGGALQRELIRRFLNAGAFGNGDDGHVLPAAATRAAMLVRINTLLQGYSGIRFEILETIATLLNANVTPCLPLRGTITASGDLVPLSYIAGLVTGRPNSVAVTPDGRKVDAAEAFKIAGIQHGFFELQPKEGLAMVNGTAVGSGLASMVLFEANVLGVLAEVLSAVFCEVMNGKPEYTDHLTHKLKHHPGQIEAAAIMEHILEGSSYMMLAKKLGELDPLMKPKQDRYALRTSPQWLGPQIEVIRAATKSIEREINSVNDNPLIDVSRGKALHGGNFQGTPIGVSMDNTRLAIAAIGKLMFAQFSELVNDFYNNGLPSNLSGGRNPSLDYGFKGAEIAMASYCSELQFLANPVTNHVQSAEQHNQDVNSLGLISSRKTAEAIDVLKLMSSTFLIALCQAIDLRHLEENVRSAVKGCVTTVARKTLSTSATGDLHKARFCEKDLLQAIDREAVFAYADDPCSANYPLMQKMRAVLIEHALANGEAERNVDTSVFAKVATFEEELRVALPREVEAARAAVENGTAAKANRITECRSYPLYRFVREELGTEYLTGEKTRSPGEEVNKVFVAMNQGKHIDALLECLKEWNGEPLPIC

SEQ ID NO: 571 - DNA, 1847 bp, Oryza sativa
atgagcgggagcggcggaggcggaggaggaggagccggcggggacggcgcgagggcgctggaccagacgccgacgtgggccgtggcggccgtctgcgccgtcatcgtcgccgcctccatcctcctcgagggcctcctccaccaccttggccagcagtggttcagcaagaggaggaagaaggcgctgttcgacgcgctggagaaggtcaaatccggagctgatgacgctggggttcatctcgttgctgctcagtgtcacggggaggtacatatcgcgcatctgcatcccggtgggagccgcggacaccatgcttccctgcagcctccggaggagttcttcagagcaggaggtgcccggtggtggtggccatggccggcgacacctatctggagatccaaccaattttaaatgcgccaaaggtatggtgtcgcttgtttcagctgatgggcttcaccagctgcatatcttcgtgttcttcctggcagtctttcatgtcgcattcagtgctattacaatgtctctgggtagagcaaaggtaagagacacgtatatggaaggagtgggagaaggagacttgctcccttacctacgagttttcatatgttttgtttttttggcctcagggtggtccatatttcattctttttatttaagaatttgtttcacatttcaatttcagacccctcaaagttcaggcttactcatcaaacgtcttttgtgaggcaacatgcaagctgttggagcaaaagtactattctgctctattttgtgagcttctttaggcagttcttcagatctgttagaaggacagactacctgactttgaggcacggattcattgctgctcatttatctctagggactaggttcaattttcggaaatacatcaaaaggtcactggaggacgattttaagacagttgttggcattagagtgcacccttatgggcttctgcgttggccattatgctcttcaatgttcatgggatggcataacttgttctggttctctacaatcccccttgtagtaactttagcagttggaacaaagctgcaggctataattgcaatgatggctgttgaaattaaagagaggcatacagtaattcaaggaatgccggtggtgaaactcagtgatgaacatttttggttcgggaagccacgtctggttcttcatcttatccatttcgcgtcatttcagcagaatgcatttgaaattacatacttcttttggatttgggtacgaattcgggttgagatcctgcttccatgacaactttgagcttatcatcgccagagtctgccttgggggttgtcgttcaattcatgtgcagctatatcacacttccactctatgctctcgtatctcaggttctccagatgggttcacagatgaagagaacgattttcgacgagcagacggcgaaggccctgaagaaatggcacaaggcagcagtggtgaagaagaagcagcagaaggggtcatcccatgagccaggttcagagacaccgggcacggagacgacgacgacgacggcgacggcaacggaggagagccagcgagaacgcgacgccgcggccatgccggtgcgccacctccaccgctacaagaccatcgcccacgtcggcgcgacggggacgctgtccgactcggactgctccgacacggacacgccgttcgcgtcgccgacgaggctcctgataccgccgacaaagcagcggagcctcgacgccgggagggcggaggtgcgcgtggacgtcgactcgacgccgacgccgacaccaccggagcgccatgacagcttctccttcccgaggttgcctgctcacaatttgcagcagaaatga

SEQ ID NO: 572 - protein, 614 aa, Oryza sativa
  misc_feature (311)..(311): Xaa = any naturally occuring amino acid
MSGSGGGGGGGAGGDGARALDQTPTWAVAAVCAVIVAASILLEGLLHHLGQQWFSKRRKKALFDALEKVKSELMTLGFISLLLSVTGRYISRICIPVGAADTMLPCSLRRSSSEQEVPGGGGHGRRHLSGDPTNFKCAKGMVSLVSADGLHQLHIFVFFLAVFHVAFSAITMSLGRAKVRTRIWKEWEKETCSLTYEFSYVFCFFGLRVVHISFFLFKNLFHISISDPSKFRLTHQTSFVRQHASCWSKSTILLYFVSFFRQFFRSVRRTDYLTLRHGFIAAHLSLGTRFNFRKYIKRSLEDDFKTVVGIXSAPLWASALAIMLFNVHGWHNLFWFSTIPLVVTLAVGTKLQAIIAMMAVEIKERHTVIQGMPVVKLSDEHFWFGKPRLVLHLIHFASFQQNAFEITYFFWIWYEFGLRSCFHDNFELIIARVALGVVVQFMCSYITLPLYALVSQVLQMGSQMKRTIFDEQTAKALKKWHKAAVVKKKQQKGSSHEPGSETPGTETTTTTATATEESQRERDAAAMPVRHLHRYKTIAHVGATGTLSDSDCSDTDTPFASPTRLLIPPTKQRSLDAGRAEVRVDVDSTPTPTPPERHDSFSFPRLPAHNLQQK

SEQ ID NO: 573 - DNA, 2336 bp, Oryza sativa
  misc_feature (53)..(53): m = adenine or cytosine
atggaggcgatcgaggagctctcggagctcgccgacgccacgcggcaggcctmcgcgctgctcgccgacgacgacccgtcggagcagcccgcgcagcggcgcgggggttcctccttcctcaccgtcgtcgcgctcggcaacatcgtgggagcggggaaatccgcggtgctcaatggattgatcggccaccccgttctccctaccggggagaatggtgcgacgagggccccaatatgcgtagatcttcagagagatgcatcactcagcagcaaatccatcatgctgcaaattgacagcaagtcgcagcaggtttctgccactcaggcattcgctgcaggaccggttaaccaaggccggtagttttgggaaggggcgatcggaggagataaatgtgaaattatgcacgagcactggcccctccattaaaactaattgatttaccggggattgatcagcggagcatggatgaatcaatgaatgatgcaattttgctagttatcgttccagctctacaagcacctgatgtagcatcttctcgagctctaaggattgccagagaactagattcagaagggtagtagaactattggtgtcgtaagtaaagttgatcaagtagccgaagaccagagagctcttcttgctgttcaggccctgcttgtaaaccaaggccctagaactgcagctgacattcagtggatagctacgattggggaactctgttcctattgcctctgttcagtctggagtaggttctgaatcctcaccagaaactatttggaaagttgaagttgaaagccttaaatctatacttcttggatctccgcaaagtaaacttggtagggaggctttagttgattcacttgctaagcagataagaacacggataaaagttagactcccaaatctcctgaatggcttcaaggcaagtctcaaataatccaggaggaattagcaaaacttggagaacagatggtccaaagttcggaaggaactcgggtcattgctttaggactttgccgggaatttgaggacaaatttcttcaacatattactggtgttgagggtggaggttggaaagttgttgcaagctttgaggggaagttcccaaccaggatcaaacaactccctctggacaagcattttgatatgaaaaatgtgaaaaggattgttcttgaggctgatggttaccaaccatacctgatatcacctgaaaaaggtttaagatctcttataaaaggtcttctagaattagcaaaggaaccatcgatactccttgtggatgaggttcaccgtgtattgctagatatagtatcagccacagcaaatgccaccccaggacttggcagatatcctctatttaagcgtgagcgcaaggtaattgcaattggatctgctgctttagatggctttaaagatgaggctaaaaagatggtaattgcactagtggatatggaacgagcattcgtgcctccccagcattttatccgcttgttgcagagaagagaatggaaaggcaacgtcacgaagatgagctgaaaagtcgctcaacaaagaaggtttcagatgcagaacctagcaaaggtttccttttcaaaaaacgtgcaaaagcaaatgactggagtaaccgctggtttgttctaaatgagagaagtggaaagcttggttacaccaagaaacaagaggagaggcattttcgaggcgtcatcaatttggagggagtgcaatcttgaggaagttttagatgaggaagatcctacgagaagccttaaagatcctaaaaagccaaatgtgccagatattggaactcctggtctcattttcaagattacccataaggcagctcacaaggctattatactgaaggctgaaagacacgatgcttagaaagccagtagatcctgaggaagagcttaaatggatatctcaagaagtccgtgggtatgtggaagctgttctcagcagtcttgcggcaaatgtccccaaggctgtggttctttgccaagttgagaaggcaaaggaaggcatgcttaatcagctctatacttcgataaggttggaggaaaggattgaagagctaatccaggaggaccacagtgtgaagcacaggcgtgaaaaaatcaaaaagcaatcatcacttctttccaaggttactcgtctgctccgtatccatgataatcgctcagctacttctaattggtcgaatgattctgctggatcagccgagccgaatgccgccgccacctccacagggtggttgatcagttcgtagttttctggtcctggggcttctgttttctcagctgcagggagtacattccattatactattgctctag

SEQ ID NO: 574 - protein, 837 aa, Oryza sativa
MQVQGFFDRLTGRNKEAWKEGRIRGTAVLVKKDVLGLGDFHASLLDGVHNGGRGKLGKPAHLEELVVTMKSTAAGESVFRVAFEWDESQGIPGAVVVTNSNRSEFFLKTLTLDGVPGKGTVVFVANSWIYPADNYQYERVFFANDLPSKMPAPLIPYRQEELNILRGDGKIGPYKEHDRIYRYDYYNDLGQPDKGSKLVRPVLGGSQELPYPRRGRTGRAPTKTSDPNTESRLPLLDLNIYVPRDERFGHLKMSDFLGYSLKAIVEGVLPIIRTYVDTTPKEFDSFQDIMELYEGGLKVANASALAEIKKRVPFELIKSLLPVAGDQVLKLPLPHVIKEKFAWRTDEEFAREMLAGVNPVMIKRLTSTLDPNVYGDHTSKITEAHIKHNMEGLTVQNALKGNRLFILDHHDHFMPFLDKINKLDGNFIYASRTILLLKDDGTLKPLAIELSLPHPDGQQHGAVSKVYTPANTGVESQIWQLAKAYASVNDSAWHQLISHWLNTHAVIEPFVIATNRQLSVVHPVHKLLSPHYRDTMNINALARQTLINADGIFEKTVFPGKYALEMSSVVYKNWKFTEQALPVDLVKRGVAVPDPTSPYNVRLLIKDYPYAVDGLVIWWAIERWVGEYLAIYYPNDGVLRGDEELQAWWKEVREVGHGDLKDQDWWPKMDTVQELTRACTIIIWIASALHAAVNFGQYPYAGFLPNRPTVSRRPMPEPGTEEYAKLERGGDEADLVFIHTITSQFQTILGISLIEILSKHSSDEVYLGQRDTPEWTSDAKALDAFKRFGSRLVDIENRIKDMNGNSALKNRNGPVKMPYMLLYPGLTAMGIPNSISI

SEQ ID NO: 575 - DNA, 2516 bp, Oryza sativa
atgcaggtgcaggggttctttgacaggttgacggggaggaacaaggaggcgtggaaggaagggaggatccgtgggacggcggtgctggtgaagaaggacgtgctcggcctcggcgacttccacgcctccctcctcgacggcgtccaccaatggagggagggggaagctggggaagccggcgcacctggaggagctggtggtgacgatgaagtcgacggcggcgggggagtcggtgttccgggtggcgttcgagtgggacgagtcgcaggggatccccggcgccgtcgtcgtcaccaactccaaccggtccgagttcttcctcaagacgctcaccctcgacggcgtccccggcaagggcaccgtcgtcttcgtcgccaactcgtggatctaccccgccgacaactaccagtacgagcgcgtcttcttcgccaacgatttgcctagcaaaatgcctgcacctttgatcccttaccggcaagaagaactcaacattctacgaggggacggtaaaattggaccatacaaggagcatgaccgtatctaccgttatgattactataacgaccttggccaaccagacaaaggcagtaaactagtacgaccagtcctcggtggcagccaagaactcccctatccccgtcgaggcagaactggccgggccccaacaaagactgtcagacccaaatacagaaagcaggcttcctctgctggacttgaacatttatgtcccacgcgacgaacggttcgggcacctcaagatgtcagacttccttgggtactctcttaaggctattgttgagggtgttctcccaataataaggacctatgtcgatacgacaccaaaggagtttgattcttttcaagacatcatggaactctatgaaggtggattgaaagtggccaatgcctctgcactagcagagatcaagaagagagttccctttgaacttattaagagtcttttgccagttgctggcgatcaagtcttgaagttacccctaccacatgttatcaaagaaatttgcttggaggactgatgaggagtttgcacgagaaatgctcgcaggagttaacccagtgatgatcaagcgtctgacgagtactctggatccaaatgtgtacggtgaccataccagcaagatcaccgaagctcacattaagcacaacatggagggcctcacggtgcaaaatgcactgaagggcaacaggcttttcatcctagaccaccacgatcacttcatgccgttcctggacaagatcaacaagttggacggtaacttcatatatgcgagcaggaccattctgctcctgaaggacgatggcaccctgaagcccctggcgatcgagctgagcctgccgcaccccgatggccagcagcacggcgccgtcagcaaggtgtacactccagccaacaccggcgtcgagagccaaatctggcagctcgccaaggcttacgcctccgtcaacgactctgcttggcaccagctgatcagccactggctgaacactcacgccgtgatcgagccgttcgtgatcgcgacgaaccggcagctcagcgtggtgcaccccgtgcacaagctgctgagcccgcactaccgcgacacgatgaacatcaacgctctggcacggcagacactcatcaacgccgatggcatcttcgagaagaccgtcttcccaggcaagtacgcgctcgagatgtcctccgtcgtgtacaagaactggaagttcaccgagcaggctctccccgtcgatctcgtcaagagagaggggtggccgtgccggacccgacgagcccgtacaacgtccggctgctgatcaaggactacccgtacgccgtggacgggctggtgatctggtgggcgatcgagcggtgggtgggcgagtacctggccatctactaccccaacgacggcgtgctccgcggcgacgaggagctgcaggcgtggtggaaggaggtgcgcgaggtcggccatggcgacctcaaggaccaggactggtggcccaagatggacaccgtccaggagctcacccgggcgtgcaccatcatcatctggatcgcgtcggcgctgcacgcggcggtcaacttcggccagtacccgtacgcggggttcctcccgaaccggccgacggtgagccggcggccgatgccggagccgggcaccgaggagtacgcgaagctggagcgcggcggtgacgaggccgacctggtgttcatccacacaatcaccagccagttccagaccatcctcggcatctcgctcatcgagatcctgtccaagcactcctccgacgaggtctacctcggccaacgcgacacgccggagtggacgtcggacgccaaggcgctggacgcgttcaagaggttcggcagccggctggtggatatcgagaaccggatcaaggacatgaacggcaactcggcgctcaagaaccggaacgggccggtgaagatgccgtacatgctgctgtaccccgggctcaccgccatgggcatccccaacagcatctccatctga

SEQ ID NO: 576 - protein, 309 aa, Oryza sativa
MATGLSGGAMTSFAVKKPLLAAAVRRRSWPPPSGRALPFSPLTRTPRSRGLGTVTCFVPQGTESQQAPAPSPPPTVPVPVPSLEEEAAAAAARRIAERKARKLSERRTYLVAAVMSSLGFTSMAVAAVYYRFHWQLEGGDVPMTEMFGTFALSVGAAVGMEFWAQWAHRSLWHASLWHMHESHHRAREGPFELNDVFAITNAVPAISLLAYGFFHRGIVPGLCFGAGLGITLFGMAYMFVHDGLVHRRFPVGPIANVPYFRRVAAAHKIHHTDKFEGVPYGLFLGPKELEEVGGLEELEKELARINRSL

SEQ ID NO: 577 - DNA, 930 bp, Oryza sativa
atggccaccggtctctccggcggcgctatgaccagcttcgccgtcaagaagccgctcctcgcggccgccgtgcgccgccggtcgtggcccccgccgtcgggccgcgcgctgccgttctcgccgctcacgcggaccccgcgcagccgcgggctcgggaccgtcacgtgcttcgtgccgcagggcacggagagccagcaggccccggctccgtccccgccgccgacggtgcccgtgcccgtgccctcgctggaggaagaggcggctgccgcggcggcgcggcgcatcgcggagaggaaggcgcggaagctgtcggagaggcggacgtacctggttgcggccgtcatgtccagcctcggcttcacgtccatggccgtcgccgccgtgtactaccgcttccattggcaactggagggcggggatgtgccgatgaccgagatgtttggcacgtttgcgctctccgtcggcgcagcggttgggatggagttctgggcgcagtgggcgcaccgctcgctgtggcacgcctccctgtggcacatgcacgagtcgcaccaccgtgcgcgcgagggcccgttcgagctcaacgacgtgttcgccatcaccaacgccgtgccggccatctccctcctcgcctacggcttcttccaccggggcatcgtccccggcctctgcttcggcgcgggcctcgggattacgctgttcggcatggcctacatgttcgtccacgacggcctggtccaccgccgcttccccgtcggccccatcgcgaatgtgccctacttccggcgagtggccgcggcccacaagatacaccacacggacaagttcgagggcgtaccgtatgggctgtttcttggacccaaggagctggaggaggttggtggtctggaagagctggagaaggagcttgcgagaatcaaccggagcttgtga

SEQ ID NO: 578 - protein, 316 aa, Oryza sativa
MGMGMRRERDAEAELNLPPGFRFHPTDDELVEHYLCRKAAGQRLPVPIIAEVDLYKFDPWDLPERALFGAREWYFFTPRDRKYPNGSRPKRAAGNGYWKATGADKPVAPRGRTLGIKKALVFYAGKAPRGVKTDWIMHEYRLADAGRAAAGAKKGSLRLDDWVLCRLYNKKNEWEKMQQGKEVKEEASDMVTSQSHSHTHSWGETRTPESEIVDNDPFPELDSFPAFQPAPPPATAMMVPKKESMDDATAAAAAAATIPRNNSSLFVDLSYDDIQGMYSGLDMLPPGDDFYSSLFASPRVKGTTPRAGAGMGMVPF

SEQ ID NO: 579 - DNA, 951 bp, Oryza sativa
  misc_feature (273)..(273): s = guanine or cytosine
atggggatggggatgaggagggagagggacgcggaggcggagctgaacctgccgccggggttcaggttccaccccacggacgacgagctggtggagcactacctgtgcaggaaggcggcggggcagcgcctgccggtgccgatcatcgccgaggtggatctctacaagttcgacccgtgggatctgcccgagcgcgcgctgttcggcgccagggagtggtacttcttcaccccgcgggatcgcaagtatcctaatgggtcacgccccaaacgsgccgccggcaacgggtactggaaggccaccggcgccgacaagcccgtcgcgccgcgggggcgcacgcttgggatcaagaaggcgctcgtgttctacgccggcaaggcgccgcgaggggtcaagactgattggatcatgcatgagtaccggctcgccgatgctggccgcgccgccgcgggcgccaagaagggatctctcaggttggatgattgggtgctgtgtcggctgtacaacaagaagaacgagtgggagaagatgcagcaggggaaggaggtgaaggaggaggcgtccgacatggttacgtcgcagtcgcactcgcacacccactcgtggggcgagacgcgcacgccggagtcggagatcgtggacaacgaccccttcccggagctggactcgttcccggcgttccagcctgcgccgccgccggcgacggcgatgatggtgcccaagaaagaatcgatggacgacgccaccgcggccgccgccgccgccgccaccatccccaggaacaacagcagcctgttcgtggacctgagctacgacgatatccagggcatgtacagcggcctcgacatgctgccgccgggcgacgacttctactcgtcgctcttcgcgtcgccgcgggtgaaggggacgacgccacgcgccggcgccggcatgggcatggtcccgttctga

SEQ ID NO: 580 - protein, 299 aa, Oryza sativa
  misc_feature (36)..(39): Xaa = any naturally occuring amino acid
  misc_feature (41)..(41): Xaa = any naturally occuring amino acid
MSDALINGVAGAGGGIIAQLLTYPLQTVRATSPPSXXXXIXLVNARQQTERDVVKHEGWERLYGGLMPSLVGTAASQGVYYYFYQIFRSRAEAAALQRSRRGIGDGSVGMLQSLTVAALSGVNVLLTNPIWVIVTRMQYKEAGFLGFWKGVVPALIMVSNPAIQFMLYETLLKKLKKRRASNLKGADGLTALEFLLGAVAKLGATVVTYPLLVVKRLQVKQIIDDDKRHRYKGHFDAITKMIRYEGLSGLYKGMSTKIVQSVFASALLFMIKEELVKGARLLVTGNTSLVKKLPSKPLR

SEQ ID NO: 581 - DNA, 901 bp, Oryza sativa
  misc_feature (108)..(108): s = guanine or cytosine
  misc_feature (109)..(109): r = adenine or guanine
  misc_feature (111)..(111): y = cytosine or thymine
  misc_feature (114)..(114): s = guanine or cytosine
  misc_feature (115)..(115): w = adenine or thymine
  misc_feature (121)..(121): r = adenine or guanine
atgtcggacgcgctgatcaacggcgtcgccggcgccggcggcgggatcatcgcccagctcctcacctacccgctccaaaccgtacgcgccacctctcctccatccttsraytgswagattrtgttgggtgaacgcgcggcagcagacggagcgcgacgtggtgaagcatgaagggtgggagcggctgtacggcggcctcatgccctcgcttgttggcactgcggcctcccagggtgtctactattacttctaccagatattccggagcagggcggaggccgcggctctccagcgatccaggagaggaatcggcgatggatccgtcgggatgctccaatccctcactgtcgctgcgctttctgggttaatgtacttctcacaaacccaatttgggtaattgttacacgaatgcaatacaaagaagctggatttttgggcttctggaaaggtgtagttccagctcttattatggttagcaaccctgcaatccaattcatgttgtacgagactcttttgaagaagttgaaaaagagacgtgcctctaatttgaagggagctgatggactgactgctcttgaattccttcttggtgctgttgccaaactgggtgcgactgttgttacatatcctcttctagttgtgaagagacttcaggtgaagcaaataattgatgatgacaagaggcaccgctacaaagggcacatttgatgcgatcacaaagatgatacgttatgaaggtttgtcagggctttataaaggaatgagcacaaaaatcgtacaaagtgtttttgcttctgctctcctttttatgattaaggaggaactggtgaagggcgctcgattattggtaaccggcaacaccagccttgttaagaagttaccatcgaagccattaagatga

SEQ ID NO: 582 - protein, 221 aa, Oryza sativa
  misc_feature (51)..(51): Xaa = any naturally occuring amino acid
  misc_feature (60)..(60): Xaa = any naturally occuring amino acid
  misc_feature (130)..(132): Xaa = any naturally occuring amino acid
MARVQLWVAAACAVVLALAAPSLAGDPDMLQDVCVADLASRVKLNGFPCKXANVTADDFXFFAGLKNPGNTNNPAGSNVTAANVQSFPGVNTLGVSMARIDYAPGGQNPPHTHPRATEIIFVLEGVLEVXXXGFITTANKLFTKTVTAGEVFVFPRGLVHFQQNRGHGPAAVIAAFNSQLQGTQAIAATLFAAAPPVPSDVLAKAFRVDVPQVDAIKAKFK

SEQ ID NO: 583 - DNA, 747 bp, Oryza sativa
atggcgagggtacagctctgggtggccgccgcgtgcgccgtcgtgctcgcgctcgccgcgccctcgctcgccggcgaccccgacatgctccaggacgtctgcgtcgccgacttggcgtcccgcggtgaagctgaacgggttcccgtgcaaggcgaacgtgacggcggacgacttcttcttcgcggggctgaagaaccccggcaacaccaacaacccggcggggtcgaacgtgacggcggcgaacgtgcagtcgttcccgggggtgaacacgctgggcgtgtctatggcgaggatcgactacgcgccggggggacagaacccgccgcacacgcacccgcgcgccaccgagatcatcttcgtcctcgagggcgtcctcgaggtgggcttcatcaccactgccaacaagctcttcaccaagactgtcaccgccggcgaggtcttcgtcttcccgcgcggcctcgtccacttccagcagaaccgcggccacggccccgccgccgtcatcgccgccttcaacagccagctccagggcacccaggccatcgccgccacgctcttcgccgccgcgccgcccgtgccgtccgacgtcctcgccaaggccttccgcgtcgacgtcccgcaggtggacgccatcaaggccaagttcaagtgatcgtagccggccgccgtcgatctcccatcattttctgcattttctttcatcaacaaaaccatctgatctactcatttgatttggttacggaataa

SEQ ID NO: 584 - protein, 707 aa, Oryza sativa
  misc_feature (126)..(126): Xaa = any naturally occuring amino acid
MASQTADATGFVASDPLSWGKAALEMTGSHLDEVKRMVAQSREAVVKIEGSSLRVGQVAAVSAAKDASGVVVELDEEARPRVKASSEWILNCIAHGGDIYGVTTGFGGTSHRRTKDGQALQVELLXRHLNAGIFGNGSDGNSLPSEVSRAAMLVRINTLLQGYSGIRFEILEAITKLINTGVSPCLPLRGTITASGDLVPLSYIAGLITGRPNAQAVTVDGKKVDAAEAFKIAGIQGGFFRLEPKEGLAIVNGTSVGSALAAMVLYDANVLAVLSEVLSAVFCEVMNGKPEYTDHLTHKLKHHPGSIEAAAIMEHILAGSAFMPHAQKVNEVDPLLKPKQDRYALRTSPQWLGPQIEVIRAATKSIEREVNSVNDNPVIDVHRGKALHGGNFQGTPIGVSMDNTRLAIANIGKLMFAQFSELVNEFYNNGLTSNLAGSRNPSLDYGFKGTEIAMASYCSELQFLANPVTNHVQSAEQHNQDVNSLGLVSARKTAEAVDILKLMSSTYLVALCQAVDLRHLEENLKSAVKNCVTTVAKKVLTTGPAGGLHSARFSEKALLTAIDREAVYSYADDPCSANYPLMTKIRAVLVEHALATAPPRRTRLLRVLQDHRVRGGAPRGAAQGDGGGARGVRDRTAPITNRIKESRSFPLYRFVREELGCVYLTGEKLKSPGEECNKVFLAISERKLIDPMLECLKEWNGEPLPIC

SEQ ID NO: 585 - DNA, 2126 bp, Oryza sativa
atggcgagccagaccgccgacgccacggggttcgtcgcgagcgacccgctgtcgtggggcaaggcggcgctggagatgacggggagccacctggacgaggtgaagcgcatggtggcgcagtcacgggaggccgtggtgaagatcgaggggtccagcctccgcgtcggccaggtggccgccgtctccgcggccaaggacgcctccggcgtggtggtcgagctggacgaggaggcccgcccccgcgtcaaggccagcagcgagtggatcctcaactgcatcgcccacggcggcgacatctacggcgtcaccaccggcttcggcggcacctcccaccgccgcaccaaggacggccaggccctccaagttgagctgctcagaggcatctcaatgccggaatcttcggcaacggctccgatggcaactcgctgccgtcggaggtgtcgcgtgcggcgatgcttgtgcgcatcaacaccctgctccagggctactcgggcatccgcttcgagatcctcgaggcgatcaccaagctgatcaacaccggggtcagcccatgcctgccgctccgaggcaccatcacggcgtccggcgacctcgtgccgctgtcctacattgccggcctcatcaccgggcgccccaacgcgcaggcggtgaccgtcgatggcaagaaggtggacgccgccgaggcgttcaagatcgccggcatccagggcggcttcttcaggctggagcccaaggaaggtctcgccatcgtgaacggcacctccgtgggctcggccctcgctgccatggtgctctacgacgcgaacgtcctcgccgtcctgtccgaggtgctgtccgccgtgttctgcgaggtgatgaacggcaagcccgagtacaccgaccacctgacgcacaagctgaagcaccacccgggctcgatcgaggccgccgccatcatggagcacatcctcgccggcagcgcgttcatgccgcacgcgcagaaggtgaacgaggtggacccgctgctgaagccgaagcaggacaggtacgcgctccgcacgtcgccgcagtggctgggaccccagatcgaggtcatccgcgcggccaccaagtcgatcgagcgcgaggtcaactcggtgaacgacaacccggtcatcgacgtccaccgcggcaaggccctgcacggcggcaacttccagggcacgcccatcggcgtgtccatggacaacacccgcctcgccatcgccaacatcggcaagctcatgttcgcccagttctccgagctggtcaacgagttctacaacaacgggctcacgtcaaacctggccggcagccgcaacccgagcttggactacggcttcaagggcaccgagatcgccatggcctcctactgctcggagctccagttcctcgccaacccggtcaccaaccacgtccagagcgcggagcagcacaaccaggacgtcaactccctcggcctcgtctccgccaggaagaccgccgaggcggtggacatcctcaagctcatgtcctccacctacctggttgcgctctgccaggccgtcgacctgcgccacctggaggagaacctcaagagcgccgtcaagaactgcgtgacgacggtggccaagaaggtgctcaccacgggccccgccggcggcctccacagcgcgcgcttcagcgagaaggccctgctcaccgccatcgaccgcgaggccgtgtacagctacgccgacgacccgtgcagcgccaactacccgctgatgaccaagatccgcgccgtgctcgtcgagcacgccctcgccaacggccccgccgagaaggacgacggctcctccgtgttctccaagatcaccgcgttcgaggaggagctccgcgaggcgctgcccagggagatggaggcggcgcgcgtggcgttcgagaccggcaccgcgccgatcaccaacaggatcaaggagagcaggtcgttcccgctgtaccgcttcgtccgcgaggagctcggctgcgtgtacctcaccggagagaagctcaagtcccccggcgaggagtgcaacaaggtgttcctggccatcagcgagcgcaagctcatcgacccgatgctcgagtgcctcaaggagtggaacggcgagcccctgcccatctgctga

SEQ ID NO: 586 - protein, 550 aa, Oryza sativa
MVLLLLQPIGEKKSIQNLDKNLSLFSSFSSSLRRAPPLVCVYKVVDFLAAIVTSHVRATTTPCRPSSSSGTALLSRLVHHAAARARFASRVIDGRGGVAAAAAVVPAAAAVVPAASGEGRRGGRRADKSGRRLEVYSEVLARLRGLGAAAPVEISPAYEDALWAHFHRLPARYALDVHADRAEDVVTHHRLLEEARDPDRRPALSVRVVQHPPPAFGSCSNLEALALEASEANLRSSNNDEDSSVHLISSSLYSESCRPMHEITFATTDKPKVLSQQLTCLLSELGLDIQEAHAFSTSDGYSLDVFVVTGWHLGGSYCSQDVAIKVVRPERISADMYRDFAQEVYIMRRKVRHRNVVQFIGACTRQPNLYIVTFMSGGSLHDYLHKKNNSFKLSEILRVATDISKGMNYLHQNNIIHRDLKTANLLMDENKVVKVADFGVARVKDQSGVMTAETGTYRWMAPEVIEHKPYDHKADVFSFGIVLWELLTGKGLRPTIPKDTHPKLSELLQKCWHRDPAERPDFSQILEILQRLPKEVSSNAPRLINLSCIS

SEQ ID NO: 587 - DNA, 1654 bp, Oryza sativa
atggtactattattactccagccaataggggagaagaagtcaatccagaacctagacaaaaacctgtctctcttctcatctttttcttcttctctacggcgagcgcctccgcttgtttgtgtctataaagttgtggactttctcgccgccattgtcacgtctcacgtgcgcgccaccaccaccccatgcagacccagcagcagtagcggcacggctctcctctctcgtctcgtgcaccacgccgccgcgcgcgctcgctttgcttcgagagtaatcgatggccgtggaggagtcgccgccgccgccgccgtcgtccccgccgccgccgccgtcgtccccgcagccagcggcgaaggtcggcgcgggggacggcgcgcggacaagagcgggcgccgcctcgaggtgtacagcgaggtactcgcccgcctccggggcctcggcgccgccgcccccgtcgagatctcgccggcctacgaggacgcgctctgggcccacttccaccgcctccccgcccgaggtacgcgctggatgtgcacgcggatagggcggaggacgtggtgacgcaccaccggttgctggaggaggcgcgcgatccggaccggcggcccgccttgtcggtgcgcgtcgtccagcatccccctcctgcctttggttcttgctccaacttagaggcacttgcgctcgaggcgagtgaggctaatctaaggagcagtaacaatgatgaagatagcagtgttcatctcatttccagtcgctatattctgaatcttgcaggccaatgcatgagataacttttgcaacaactgataagccaaaggtccttagtcagcagctgacttgcttgcttagtgagcttggtcttgacatccaagaagcgcatgcattttcaacaagtgatggttactcattggatgtatttgttgtcactggttggcaccttgggggatcatactgcagtcaggatgtagctattaaagtagtgagacctgaacgcattagtgcagatatgtaccgtgattttgcacaggaagtctacattatgagagaaaggtccgccatagaaatgttgtacagtttatcggtgcctgtacaagacagcccaacttatatattgtaacagttcatgtcaggaggtagtctgcatgattaccttcataaaaagaacaattctttcaagctatccgaaatactgagagtggcgacagatatctctaaaggaatgaactatctgcatcagaacaacataattcaccgtgatctcaagacagcgaatcttcttatggatgaaaacaaggtcgtaaaggttgcagattttggtgttgcacgtgtcaaagatcaatccggagtgatgactgcagagactggaacttatcgttggatggcacctgaggtcattgaacataagccctatgatcataaagcagatgtttttagctttggtattgttctatgggagctgctaactggcaagggccttagaccaacaattccgaaagatacgcaccccaagctgtctgagctgcttcagaaatgctggcatagagatcctgctgaaaggcctgacttctcccagatactggagattcttcagagactccccaaagaggtcagttctaatgcacctcgactcatcaatttatcatgcatttcttaa

SEQ ID NO: 588 - protein, 564 aa, Oryza sativa
  misc_feature (112)..(112): Xaa = any naturally occuring amino acid
  misc_feature (118)..(120): Xaa = any naturally occuring amino acid
  misc_feature (277)..(277): Xaa = any naturally occuring amino acid
  misc_feature (280)..(280): Xaa = any naturally occuring amino acid
  misc_feature (305)..(305): Xaa = any naturally occuring amino acid
  misc_feature (483)..(483): Xaa = any naturally occuring amino acid
MEVRRRAPLPPPPGRVQAGDALPLPIRHTNLIFSALFAASLAYLMRRWREKIRSSTPLHVVGLAEMLAIFGLVASLIYLLSFFGIAFVQSIVSSSDDEEEDFLVGPARGSSXAAAVAXXXPPSSPAQCSLLGSPHDDAARERMPEEDEEIVSSVVAGKVPSYVLETKLGDCRRAAGIRREAVRRITGRQIEGLPLDGFDYASILGQCCELPVGYVQLPVGIAGPLLLDGQRFYVPMATTEGCLVASTNRGCKAIAESGGAVSVVLRDGMTRAPVARXPTXRRAAELKAFLEDSVNFNTLSMVFNXRSSRFARLQGVQCAMAGRNLYMRFSCCTGDAMGMNMVSKGVQNVLDYLQDDFPDMDVISISAGNFCSDKKPAAVNWIEGRGKSVVCEAVIKEDVVKKVLKTNVQSLVELNVIKNLAGSAVAGALGGFNAHASNIVTAIFIATGQDPAQNVESSHCITMLEAVNDGRDLHISVTMPSIXEVGTVGGGTQLASQAACLDLLGVKGANRESPGSNARLLATVVAGGVLAGELSLLSALAAGQLVKSHMKYNRSSKDMSKVIS

SEQ ID NO: 589 - DNA, 1752 bp, Oryza sativa
  misc_feature (335)..(335): s = guanine or cytosine
  misc_feature (353)..(353): m = adenine or cytosine
  misc_feature (354)..(354): k = guanine or thymine
  misc_feature (355)..(355): y = cytosine or thymine
  misc_feature (432)..(432): s = guanine or cytosine
  misc_feature (829)..(829): y = cytosine or thymine
  misc_feature (834)..(834): m = adenine or cytosine
  misc_feature (839)..(839): y = cytosine or thymine
atggaggtgcgccgcagggcgccgctgccgccgccgcccgggagggtgcaggcgggcgacgcgctgccgctgccgatccggcacacgaacctgatattctcggcgctgttcgcggcgtcgctggcgtacctgatgcggcggtggcgggagaagatccggtcgtcgacgccgctccacgtggtggggctcgccgagatgctcgccatcttcggcctcgtcgcctcgctcatctacctcctcagcttcttcggcatcgccttcgtgcagtccatcgtctcctagcagcgacgacgaggaggaggacttccttgtcgggcccgccgtggctcctccgsggcggcggccgtcgcgcmkyattagccgccttcttctccggcgcagtgctcgctgctgggtagcccccacgacgatgccgcgcgggagagaatgccsgaggaggacgaggagatcgtgtcgtcggtcgttgccgggaaggtcccctcctacgtgctggagaccaagctcggggattgccgccgcgcagccggaatccggcgcgaggcggtccggcggatcaccgggaggcagatcgaggggctcccgctcgacggattcgactacgcctcgatcctcgggcagtgctgcgagctcccagtggggtacgtgcagctccccgtcggcatcgccgggccgctcctgctcgacggccagcggttctacgtccccatggccaccaccgaggggtgcctcgtcgccagcacgaaccgcggctgcaaggccatcgccgagtccggcggcgccgtcagcgtcgtcctccgcgacgggatgacgcgcgcccccgtcgcccgcytcccmaccgytcgccgcgccgccgagctcaaggccttcttggaggattctgtcaacttcaataccctctccatggtcttcaatagaggtccagtagattcgcgaggctgcaaggggtacaatgtgccatggctgggaggaacctgtacatgagattcagctgctgcacgggggatgccatggggatgaatatggtctccaagggcgtgcagaatgtgctggattacctccaagatgacttccctgacatggatgttattagcatctcagcaggtaacttttgctctgacaagaagccagctgctgtgaattggatcgaagggcgcggtaaatctgtggtttgtgaggcagtaatcaaggaggatgtagtcaaaaaggtgctgaagaccaatgtgcaatcgttggtagagctcaacgtgatcaagaatcttgctggttcagctgttgctggggctcttgggggtttcaatgcccatgctagcaatattgtaactgcaatcttcatagccactgggcaggatcctgcccagaatgtggaaagctctcactgcatcacaatgttggaagctgtaaatgatggcagagaccttcacatctccgttactatgccatcaattgagaggtgggcacagttgggggagggactcagctggcgtcacaggctgcttgcttggacctgctcggcgtgaaaggcgcgaacagggaatccccgggatcaaacgcgaggctcctggccaccgtggtggcaggtggtgtccttgccggggagctgtccctcctatctgcactcgccgcaggccagcttgtcaagagccacatgaaatacaacaggtccagcaaagacatgtccaaggtgatttcctagtcctagtagttcgaggtttggatcgttgcattggaaagaaagaaagaaaaaatggatag

SEQ ID NO: 590 - protein, 515 aa, Oryza sativa
  misc_feature (173)..(173): Xaa = any naturally occuring amino acid
MDKAYIAVFSIVILFLLVDYLRRLRGGGTSNGKNKGMRLPPGLPAVPIIGHLHLVKKPMHATLSRLAARHGPVFSLRLGSRRAVVVSSPGCARECFTEHDVAFANRPRFESQLLMSFDGTALAMASYGPHWRNLRRVAAVQLLSARRVGLMSGLIAGEVRAMVRSLCRRPAAXAAPVQLKRRLFELSLSVLMETIAQSKATRPETTDTDTDMSMEAQEYKQVVEEILERIGTGNLCDYLPALRWFDVFGVRNRILAAVSRRDAFLRRLIYAARWRMDDGEKKSMIAVLLTLQKTQPEVYTDNMITALCSAKNLLGAGTETTSTTIEWAMSLLLNHPETLKKAQAEIDASVGNSRLITADDVPRITYLQCIVRETLRLYPAAPMLIPHESSADCEVGGYSVPRGTMLLVNAYAIHRDPAAWEEPERFVPERFEGGGCDGNLSMPFGMGRRRCPGETLALHTVGLVLGTLIQCFDWERVDGVEVDMAEGGGLTMPKVVPLEAVCRPRDAMGGVLREL

SEQ ID NO: 591 - DNA, 1545 bp, Oryza sativa
atggataaggcctacattgccgtcttctccatcgtcatcctcttcttgctcgtcgactaccttcgtcgtcttcgtggcggcggcacgagcaatggcaagaacaaggggatgcggctgccgccgggtctaccggccgtcccgatcatcggccacctccacctcgtcaagaagccgatgcacgcgacgctgtcccgcctcgccgcgcggcacgggccggtgttctcgctgcgcctcggctcgcggcgcgccgtggtggtgtcgtcgccggggtgcgccagggagtgcttcaccgagcacgacgtggccttcgcgaaccggcccaggttcgagtcgcagctgctcatgtcgttcgacggcaccgcgctggccatggcgagctacggcccgcactggcgcaacctccgccgggtcgccgcggtgcagctgctctccgcgcgccgcgtcggcctcatgtcggggctcatcgccggcgaggtgcgcgccatggtgcggagcttgtgccgccgcccagccgccgccgcgccagtccagctgaagcggaggctgttcgagctctccctgagcgtgctcatggagaccatcgcccagagcaaggcgacccgacccgagacgacggacacggacacggacatgtccatggaagcccaggagtacaagcaggtcgtcgaggagatcctcgagcgcatcggcacgggcaacctgtgcgactacctgccggcgctccggtggttcgacgtgttcggcgtgaggaacaggatcctcgccgcggtgagccggagggacgcgttcctccgtcgactgatctacgcggcgcggtggaggatggacgacggcgagaagaagagcatgatcgccgtgctgctcactctgcagaagacacagccggaggtgtacactgacaacatgatcacggctctttgctcggcgaagaacttgttaggagcaggaacagagacaacctcgacgacgatagaatgggcaatgtcgctgttgctgaaccacccagaaacgctcaagaaagcacaagccgagatcgacgcgtccgtcggcaactcccgcctgatcaccgccgacgacgtgccccgcatcacctatctccagtgcatcgtcagggagacgctccgcctctaccccgcggcgccgatgctcatcccgcacgagtcctccgccgactgcgaggtcggcggctacagcgtcccgcgcgggacgatgctgctcgtgaacgcgtacgccatccaccgtgacccggcggcgtgggaggagccggagaggttcgtgccggagaggttcgagggcggcgggtgcgacggcaacctctcgatgccgttcgggatggggaggcggaggtgccccggcgagacgctggctctgcacacggtggggctggtgctgggcacgctgatccagtgcttcgactgggagagggtcgatggcgtggaggtcgacatggctgagggtggcgggctcaccatgcccaaggtcgtgccgttggaggccgtgtgcaggccgcgcgacgccatgggtggtgttcttcgcgagctctga

SEQ ID NO: 592 - protein, 518 aa, Oryza sativa
MVKAYIAIFSIAVLLLIHFLFRRRGRSNGMPLPPSPPAIPFFGHLHLIDKPFHAALSRLAERHGPVFSLRLGSRNAVVVSSPECARECFTDNDVCFANRPRFPSQMLATFNGTSLGSANYGPHWRNLRRIATVHLLSSHRVSGMSGIISGQARHMVRRMYRAATASAAGVARVQLNRRLFELSLSVLMEAIAQSKTTRREAPDADTDMSMEAQELRHVLDELNPLIGAANLWDYLPALRWFDVFGVKRKIVAAVNRRNAFMRRLIDAERQRMDNNDVDGGDDGEKKSMISVLLTLQKTQPEVYTDTLIMTLCAPLFGAGTETTSTTIEWAMSLLLNHPEILKKAQAEIDMSVGNSRLISVVDVHRLGYLQCIINETLRMYPAAPLLLPHESSADCKVGGYHIPSGAMLLVNVAAIQRDPVIWKEPSEFKPERFENGRFEGLFMIPFGMGRRRCPGEMLALQTIGLVLGTMIQCFDWGRVDDAMVDMTQSNGLTSLKVIPLEAMCKPREAMCDVLRKFM

SEQ ID NO: 593 - DNA, 1557 bp, Oryza sativa
atggttaaggcctacattgccatcttctccatcgccgttctcttgttgattcacttcctcttccgccgccgcggcaggagcaatggcatgccgctgcctccgagccctccagccatcccgttcttcggccacctccacctcatcgacaagccgttccacgccgcgctgtcccgcctcgccgagcgccacggcccggtcttctcgctgcgcctcggctcgcgcaacgccgtcgtggtgtcgtcgccggagtgcgccagggagtgcttcacggacaacgacgtgtgcttcgccaaccgccccaggttcccgtcgcagatgctcgcgaccttcaatggcacctctctaggcagtgccaactacggcccgcactggcgcaacctccgccgcatcgccaccgtgcacctcctctcctcgcaccgcgtcagcggcatgtctggcatcatctccggccaggcgcgccacatggtgcggaggatgtaccgcgccgccaccgcctccgccgccggcgtcgcgcgcgtccagctgaatcggaggctgttcgagctctcgctcagcgtcctcatggaagccatagcccagagcaagacgacacgtcgtgaggcgccggatgcggacacggacatgtccatggaggcccaggagttgaggcatgtcctcgacgagctcaacccgcttatcggcgcggccaacctgtgggattacttgccggcgctccggtggttcgacgtgttcggcgtgaagcgcaagatcgtggcggcggtgaacaggaggaacgcgttcatgcgccggctgatcgacgcggagcggcaaaggatggacaacaacgatgtcgacggcggcgatgatggcgagaagaagagcatgatttccgtgctgcttactctgcaaaagactcagccagaggtctacacggatactctgatcatgactctctgtgcgccattgtttggtgccggaacagagactacatcaaccacaatagagtgggcgatgtcacttctactgaaccatccagagattctaaagaaagcacaagcagaaatagacatgtccgtcggaaactctcgcctaatcagtgtcgtcgacgtgcatcgtctgggctatctccagtgcatcatcaacgagacgcttcgcatgtaccctgcagcgccacttctgctacctcatgaatcatctgcggattgcaaagtcggtggctaccacatcccaagcggagcgatgttgcttgtcaacgtggctgccatccaaagagacccagtgatttggaaagagccaagtgagttcaagccagagaggttcgagaatggcaggttcgagggattgttcatgataccgtttgggatggggagacggaggtgtcccggggagatgctggcattgcagacaattgggttagttttggggactatgatccagtgctttgattggggcagagttgatgatgctatggttgatatgacacagagcaatggactgactagcctcaaggtcattccgttggaggccatgtgcaaaccacgagaagctatgtgcgatgttcttcggaaattcatgtga

SEQ ID NO: 594 - protein, 527 aa, Oryza sativa
MDKAYIAVFSIAILFLLVDYFRCRRRRGSGSNNGENKGMLQLPPSPPAIPFFGHLHLIDKPLHAALSRLAERHGPVFSLRLGSRNAVVVSSPECARECFTDNDVCFANRPQFPSQMPATFYGAGFGFANYGAHWRNLRRIATVHLLSAHRVRGMAGVVSGEIRPMVQRMYRAAAAAGVGVARVQLKRRLFELSLSVLMEAIAQTKTTRPEADDADTDMSVEAQEFKNVLDELNPLLGAANLWDYLPALRVFDVLGVKRKIATLANRRDAFVRRLIDAERQRMDNGVDGGDDGEKKSVISVLLSLQKTEPEVYKDIVIVNLCAALFAAGTETTAMTIEWAMSLLLNHPKILKKAKAEIDASVGNSRLINGDDMPHLSYLQCIINETLRLYPVAPLLIPHESSADCKVNGYHIPSGTMLLVNVIAIQRDPMVWKEPNEFKPERFENGESEGLFMIPFGMGRRKCPGETMALQTIGLVLGALIQCFDWDRVDGAEVDMTQGSGLTNPRAVPLEAMCKPREAMSDVFRELL

SEQ ID NO: 595 - DNA, 1584 bp, Oryza sativa
  misc_feature (483)..(483): r = adenine or guanine
atggataaggcctacattgccgtcttctccattgccatcctcttcttgctcgtcgactacttccgctgtcgccgccgccgcggcagcggcagcaacaatggcgaaaacaaggggatgttgcagctgcctccgagccctccagccatcccgttcttcggccacctccacctcatcgacaagccgttgcacgccgcgctgtcccgcctcgccgagcgccacggcccggtgttctcgctgcgcctcggctcgcgcaacgccgtcgtggtgtcgtcgccggagtgcgccagggagtgcttcacggacaacgatgtgtgcttcgccaaccgcccgcagttcccctcgcagatgcccgcgacgttctacggcgccgggttcggcttcgccaactacggcgcgcactggcgcaacctccgccgcatcgccaccgtgcacctcctctccgcgcaccgcgtcaggggcatggccggcgtcgtctccggcgaratccgccccatggtgcagaggatgtaccgcgccgccgccgccgccggcgtcggcgttgcgcgcgtccagctgaagcggaggctgttcgagctctcgctcagcgtcctcatggaagccatagcgcagaccaagacgacgcggccagaggcggacgacgcggacacggacatgtccgtggaggcccaggagttcaagaatgtcctcgacgagctcaacccgcttctcggcgcggccaacctgtgggattacttgccggcgctccgggtgttcgacgtgctcggcgtgaagaggaagatcgcgacgctggccaacaggagggacgcgttcgtgcgccggctgatcgacgcggagcggcagaggatggacaacggtgtcgacggcggcgatgatggcgagaagaagagcgtgatctccgtgctgcttagtctgcaaaagactgagccagaggtctacaaggatatagtgatcgtgaatctttgtgcggcattatttgctgctggaacagagactacagcaatgacaatagaatgggcaatgtcgcttctgctgaatcatcccaagatactcaagaaagcaaaggcagaaatagacgcatccgtcgggaactctcgcctgatcaatggagacgacatgcctcatcttagctatctccagtgcatcatcaacgagacgcttcgtctataccctgtagcaccactgttgatccctcacgaatcatccgcagattgtaaggttaatggctatcacattccaagtggaacgatgctgcttgtcaatgtgatcgccatccaaagagatccaatggtttggaaagagccaaatgagtttaagccagagaggttcgaaaacggcgagtccgagggattgttcatgataccgtttgggatggggagacggaagtgtccgggagagacgatggctttgcagacaattgggttggttttgggggctctgatccagtgcttcgattgggacagagtcgatggcgccgaggttgatatgacgcaaggcagtggactgaccaaccctagggctgtcccgttggaggccatgtgcaaaccacgcgaagctatgtctgatgtttttcgggaactcttgtga

SEQ ID NO: 596 - protein, 423 aa, Oryza sativa
MRLGVYHDVLQRLRDAGAPEALAPDFAEKLWTHFHRFNAYAMDVNVERAEDVLMHMKLLEKAIHPENQPAFSVRIVQLSCRPMHEITFASDDKPKGLTQLFQLSSLLGNLNLDIKEVHALSTNDGYFLDIFIVIGWDHKIPKDNTDEWEINFDVLDIQEKVASGTYGDLRGTYFGEDVAIKVLKSDRLNENMQEEFNEEVFIMRGRIRHKNIVRFLGACTKSPTLCIVTEFMKNGSVYDYLHKRKGSFKLPSLLKAAVDISKGMNYLHQNKIIHRDLKTANLLMDEHELIKVADFGVARVKAESGIMTAETGTYRWMAPEVIEHKPYDSKADVFSFGVVLWELLTGKIPHEFLTPLQAAIGVVQEVKRGLRPVIPKATDPKLALLLESCWQQNAVNRPDFVQILQKLDEIAGEVGICDLFTIS

SEQ ID NO: 597 - DNA, 1272 bp, Oryza sativa
atgaggctgggggtgtaccacgacgtgctgcagcggctcagggacgccggcgcgcccgaggccctcgcgccggacttcgccgagaagctctggacgcacttccaccgcttcaacgccagtatgccatggatgtcaatgttgagagggcagaagacgttctgatgcacatgaagctgcttgagaaggctatccatcctgaaaatcagcctgccttctcagtgagaattgttcagttatcttgcagacccatgcatgagatcacctttgcatctgatgacaaaccaaagggccttactcaattatttcagctgtcttcacttctaggcaatctcaatcttgatatcaaagaagtacatgcactttcaacaaatgatggttacttcttagatattttcatcgtaatcggatgggatcacaagatacctaaagataacacagatgaatgggaaattaacttcgacgtattggatattcaagagaaagtggcatctggaacgtatggtgatctcgcggtacatattttggtgaagatgtcgcaattaaggtgctcaagtcagatcgtcttaatgagaacatgcaggaggaatttaacgaagaagtattcatcatgagaggaagattcgtcataagaacattgttcgatttcttggggcatgcaccaaatccccaaccttatgtattgtcacaggagtttatgaaaaatggaagtgtttacgactaccttcataagcgtaaaggttccttcaaacttcccagtctgcttaaagctgcagttgatatatcaaaagggatgaactatttacaccaaaataaaattattcatcgagacttgaagacagcaaaccttcttatggatgagcacgagcttatcaaggttgctgattttggtgttgcacgtgtaaaagctgaatcagggattatgactgccgaaactggtacatatcgttggatggctcctgaggttattgagcataagccatatgattcaaaggctgatgtctttagctttggtgttgttttgtgggagctacttacgggaaagattcctcacgagtttctaacaccactccaagcagccataggtgttgttcaagaggtcaagagggtttaagaccagttattcccaaggccacagatcctaaactcgcgctgttacttgagagttgctggcagcaaaatgctgtcaacagaccagactttgtacaaattttgcaaaagcttgatgaaattgctggggaggtaggcatctgtgacctatttaccatttcatga

SEQ ID NO: 598 - protein, 500 aa, Oryza sativa
  misc_feature (8)..(8): Xaa = any naturally occuring amino acid
WTTTPPGXASGGYTTTAAAHFVLVPMMAQGHAIPMTDMARLLAEHGAARVSLVVTPVNAARMAGFAAGVEEAGLPVQLVELPFPAAEFGLPDGCENVDMLPSKDLFSNFLLACGALREPFAARLRQQRPPASCIISDMIHSWAGDIARELGVPWAHVQRSCTFSSLCQQRDIIYRKNLLENLTDDEIVKVSGFPTPLELPKARCPGTLCVPGLKQISDKIYEAETRSDGRIMNSFQEMESLYIESFERTIGKKIWTIGPMCLCHRDSNAMAARGNKASMDDAKCLQWLDSKKPGSVIFVSFGSLSSTDPQQLVELGLGLEASKKPFIWVIKAGKKFPEVEEWLADGFEERVKDRGMIIRGWAPQMMILWHQAIGGFMTHCGWNSTLEGISAGVPMITWPHCSEQFVNEKLVVDHLKIGVEVGVKGVTQWGTEQKEVKVTRTAVETAVSMLMDEGEVAQEIRMRAKDFGMKARRALEEGGSSYNNIKLLIQEMGNKQNASG

SEQ ID NO: 599 - DNA, 1549 bp, Oryza sativa
  misc_feature (25)..(25): m = adenine or cytosine
  misc_feature (196)..(196): y = cytosine or thymine
atggacgacgacaccgcccggccamgcctccggcggctacacgacgacggcggcggcgcacttcgtgctggtcccgatgatggcgcagggccacgccatccccatgaccgacatggcgcgcctgctggccgagcacggcgcggcgcgggtcagcctcgtcgtcacgccggtcaacgccgccaggatggccgggttygccgccggcgtggaggaggccggcctgccggtgcagctggtggagctccccttcccggccgccgagttcggcctgccggacggctgcgagaacgtcgacatgctcccgtccaaagacctcttcagcaacttcctcttggcctgcggcgcgctccgggagccgttcgcggcgaggctccggcagcaacggccgccggcgagctgcatcatctccgacatgatacactcgtgggccggtgacatcgccagggagctcggcgtcccatgggctcacgttcaacggctcctgcaccttctcctccctttgccagcagggacatcatttatcgcaaaaatctattggagaacctcacggatgatgagatcgtcaaagtctcagggttccctacgccgctagagttgccaaaagctagatgccctggaacactgtgcgttccaggtctgaagcaaataagtgacaagatttacgaggctgagacgcgaagcgatggcaggatcatgaatagcttccaggagatggaatctctgtacatcgagtcgtttgagcgaaccataggtaagaagatctggacgatcggcccaatgtgcctttgtcacagagacagcaacgccatggctgctagaggaaacaaggcgtcaatggatgatgcgaaatgtttgcaatggcttgattcaaagaagcctggttcagtgatctttgtcagctttggcagcctctccagcaccgaccctcagcagcttgttgagctggggctgggacttgaagcttccaagaaaccattcatctgggtgatcaaagcaggaaaaaagtttccagaagtcgaggaatggcttgcagatgggttcgaggagcgcgtcaaagacagaggcatgatcataaggggctgggcgccacagatgatgatcctgtggcaccaggccattggagggttcatgacgcactgcgggtggaactcgacactagagggcatctccgcgggtgtgccgatgatcacatggccacactgttcagagcagtttgtgaatgagaaattggtggtggatcacctgaaaattggggtggaggttggagtgaaaggagtgacacagtggggaactgaacaaaaagaggttaaggtgacaaggactgctgtggagacagcggtatccatgttgatggatgaaggggaagttgcacaggagattaggatgagagcaaaagattttggcatgaaggcaagaagggctttggaagagggaggttcttcctataacaacataaaactattaattcaagaaatgggaaacaagcaaaatgcatctggttgatacatatggaaataagctttattttttcttaattgtaaatctgtaa

SEQ ID NO: 600 - protein, 1011 aa, Oryza sativa
MMSNLKLGVEVTSAHDLLPKEQGTCNPYVEIEFDDQKFRTAIKERDINPVWNEQFYFNISDPSRLTEKDLEAYVYHANRASNSKTCLGKVRISGTSFVSHSDATPLHYPLEKRTILSRARGELGLRVFLTDDPSVRVSAPGQEFDFISTPTTAQEQVAANAIPNPFQETRADQVRQFQHLPKEQHQHRPQPMTAQPYYPESSYGQQQQKTYSAVGNKAEGPPPPVMRMYAQGPQQQPVEFQLKETSPTLGGGRVIGGRVIPGEKAGAYDLVEKMQYLFVRVVKARDLPHMDITGSLDPYVEVHLGNYKMKTRHFEKNQRPEWDEVFAFPREVMQSTSLEVIVKDKDFIRDDYVGRVSIDLNEVPLRVPPDSPLAPEWYRLVGKEGHRDKGELMLAVWYGTQADECFPSAIHAGSEPIDSHLHNYIRGKVYPVPRMWYVRVNVIGAQDIFPMENHIPDVFVKVRLGHQMLKTRPARSPTRNFMWNEEMMFVAAEPFEEDLIIQIEDRVAQNKDEVIGETMIPLARLPRRADHKPVLPAWFDLRRPGLIDLNQLKEDKFYAKVQLRICLEGGYHVLDESTQYCSDLRPTMKQLWKPPIGLLEVGILSANGLNPTKTKHERGSCDAYCVAKYGQKWVRTRTIVDNLNPRFNEQYTWDVFDHGTVLTIGLFDNCHISADSNHSSSPGHMDKPIGKVRIRLSTLETGRVYTHTYPLLVLHPSGVKKMGELHLAIRFTATSLLNVLFTYSRPLLPKMHYAQPLSIVQQEMLRHQAVQLVAQRLGRMEPPVRREVVEFMSDARSHLWSMRRSKANFFRLMQVFSGFIAAGKWFGDVCQWKNPVTTVLVHVLFIMLVFYPDLILPTIFLYMFLIGLWNYRFRPRFPPHMNTRISHADMTNPDELDEEFDTFPTSKSPDLVRMRYDRLRHVAGRIQTVVGDIATQGERLQSLLSWRDPRATSMFLLFCLLTAVILYVTPFQVIALCLGFFWMRHPRFRHKVPSAPVNFFRRLPAKTDSLL

SEQ ID NO: 601 - DNA, 3036 bp, Oryza sativa
atgatgagcaatcttaagcttggggtggaggttaccagtgctcatgacctcctaccaaaagagcagggcacatgcaacccctatgtcgagatcgaattcgatgaccagaagttccgcacagccatcaaagagagggatatcaaccctgtctggaacgagcagttctacttcaacatatctgatccatcccgcctcactgagaaagacctcgaggcgtatgtgtaccacgcaaaccgcgccagcaattccaagacttgccttggcaaggttcggatctccggtacatcctttgtcagccactcagatgccacacctcttcactaccccctggagaagcgcacgatcttatcccgtgctcgtggtgagctcggtctcagggtgttccttacagatgatccatcagtcagagtgtccgctcctggtcaggagttcgacttcataagcacgcctacgactgcccaagagcaggtagccgccaatgccattccaaatcctttccaggagaccagagcagatcaagtgaggcaattccaacacttaccaaaagaacagcaccagcaccgtccgcagccaatgactgcgcagccatactaccctgaaagttcatacggacaacagcaacagaaaacctactctgctgtcgggaacaaagctgaaggtcctccacctccagtcatgaggatgtatgctcaaggtccacagcagcagcctgtagaattccagctgaaggaaacaagcccaacacttggtggcggacgtgttattggcggccgggtgatccccggtgaaaaggcaggggcatacgaccttgttgagaagatgcagtacctatttgtgcgtgtggttaaggcccgtgatctgccccacatggacatcactgggagtcttgatccttatgttgaggtgcacctcggaaactacaaaatgaagacaaggcactttgagaagaaccagaggcctgagtgggatgaggtgtttgctttccctagggaagtaatgcagtcaacgtcacttgaagttattgtgaaggataaggacttcattcgggatgattatgttggccgggtgtcaatagatctaaatgaggtaccactaagggtccctcctgacagcccattggcaccagagtggtatcgacttgtggggaaggaagggcacagggataaaggggagctgatgctcgctgtctggtatggaactcaagcagatgagtgcttcccaagtgccatccacgcaggatcagaaccaattgattcccatcttcacaactacatccgtgggaaggtctaccctgtacccagaatgtggtatgtgagggtcaatgtaattggggcacaggatatatttccaatggagaaccacatacctgatgtatttgttaaggtgaggctgggccaccaaatgctgaagacaaggccagctcgctcaccaaccagaaacttcatgtggaatgaggagatgatgtttgtcgcggcagagcctttcgaggaggacttgatcatacaaatagaggatcgagttgctcagaacaaggatgaagtgattggtgaaactatgatacctctcgcaaggcttccaaggagggctgaccataagccagtgctgccagcatggtttgatctcagaaggccaggactgattgatctgaaccaactaaaggaagataaattctatgcaaaggtgcaacttcgtatttgccttgaaggtggttaccatgtgctcgatgagtccacacagtactgtagcgatctccggccaacaatgaagcagctgtggaaaccaccaatcggtctgcttgaagttggcattctaagtgcaaatgggctcaatccaacaaagaccaagcatgagcgggggtcatgcgatgcatattgtgttgccaagtatggtcagaaatgggtgcggacacgtactattgttgacaacttgaaccctagattcaatgaacagtacacatgggatgtcttcgaccatggaacagtgctcaccattggtttatttgacaactgccacatatctgcagacagcaaccacagtagttcccccggccatatggacaagcccatcgggaaagtgcgaattcggctttcaactcttgagactgggagggtgtacacacacacgtatccattacttgtcctccacccatcaggagttaagaaaatgggagaactccacctggccatcaggttcacagccacatcccttctcaatgtgctcttcacatattctcggcccctcttgcccaagatgcattacgcgcaaccactgtcaatagtgcagcaggaaatgctccgccaccaagctgtgcaacttgtcgcacagcgtctagggcgcatggagccaccagttcgcagggaagttgttgagttcatgtcagatgcccgctcacacctgtggagcatgcggcgaagcaaggctaacttcttccgtcttatgcaagtcttctccggattcattgctgcaggaaagtggtttggcgacgtttgtcagtggaaaaacccagtcacaacagttttagttcatgtgctatttatcatgcttgtcttctacccagaccttatcctcccaacaatcttcctctacatgttcttgataggattgtggaattaccggttccggccgcgtttcccacctcatatgaacacaaggatatctcatgccgatatgacaaacccagatgagcttgatgaagaatttgatacattcccaacatcaaagagtccagatctggttaggatgaggtatgacaggctacggcatgttgctgggaggatacagacagttgttggggacattgcaactcaaggagagaggctgcagtcgctgctcagctggagggatccaagggcaacatctatgttcctattgttttgcctgcttactgcagttatcttgtatgtgacaccattccaagtgattgcactctgccttggtttcttctggatgaggcacccacggtttcgtcataaggttccatcggcacctgtgaacttcttcaggaggctacctgcaaagacagattctttgctataa

SEQ ID NO: 602 - protein, 292 aa, Oryza sativa
MAVARLVVITPAVLLGRTARVSPSAVPRLRPIVAGRRAVAAPTRAVLGDGAGVGGEEDAVVAVVEEDAVARRAARKRSERRTYLVAAVMSSLGFTSMAAAAVYYRFAWQMEAGGGDVPATEMVGTFALSVGAAVGMEFWARWAHRALWHASLWHMHESHHRPRDGPFELNDVFAIANAAPAISLLAYGLLNRGLLPGLCFGAGLGITLFGMAYMFVHDGLVHRRFPVGPIENVPYFRRVAAAHQIHHTDKFEGVPYGLFLGPKELEEVGGTEELDKEIKKRIKRKEAMDAIR

SEQ ID NO: 603 - DNA, 879 bp, Oryza sativa
  misc_feature (45)..(45): s = guanine or cytosine
atggccgtcgcgaggctggtggtcatcacccccgccgtcctcctsggccgcaccgcccgcgtctcgccgtcggcggtgccgcggctgcggcccatcgtcgccggccgccgcgccgtggcggcgcccacacgcgccgtcctgggagacggggcgggtgtcggcggcgaggaggatgcggtggtggcggtggtggaggaggacgcggtcgcccggcgcgcggcgaggaagcggtcggagcggcgcacgtacctggtggcggcggtgatgtccagcctcgggttcacgtccatggccgccgccgccgtctactaccgcttcgcctggcaaatggaggccggcggcggcgacgttccggcgacggagatggtcggcacgttcgcgttgtcggtgggggcggcggtggggatggagttctgggcgcggtgggcgcaccgggcgctgtggcacgcgtcgctgtggcacatgcacgagtcgcaccaccgcccgcgcgacggcccgttcgagctcaacgacgtcttcgccatcgcaaacgccgccccggccatctccctcctcgcctacggcctcctcaaccgcggcctcctccccggcctctgcttcggcgcggggcttgggattacgctgttcgggatggcgtacatgttcgtccacgacggcctggtccaccggcgcttccccgtggggcccatcgagaacgtgccctacttccgccgagttgctgccgcccaccagatacatcacacggacaagttcgaaggcgtgccctacggcctgttcctcggacccaaggagttggaggaggtgggtgggactgaggagctggacaaggagatcaagaagaggatcaagaggaaggaggccatggacgccatcagatga

SEQ ID NO: 604 - protein, 707 aa, Oryza sativa
  misc_feature (125)..(125): Xaa = any naturally occuring amino acid
  misc_feature (551)..(557): Xaa = any naturally occuring amino acid
  misc_feature (599)..(606): Xaa = any naturally occuring amino acid
  misc_feature (613)..(613): Xaa = any naturally occuring amino acid
  misc_feature (638)..(638): Xaa = any naturally occuring amino acid
MECETGLVDRPLNGDPLYWGKAAEGLAGSHLDEVKRMVVEYRAPLVKIDGAMLSVAKVAAVAGEAARVQVVLDESARPRLEASREWVFDSTMNGTDTYGVTTGFGGAAHRRTKEFAALQKELIRXRYLNAGVFGASRSDGYTLPTEVTRAAMLVRINTLTQGYSGIRFEILEAIAKLLNANVTPCLPLRGTITASGDLVPLSYIAGLITGRQNSAAVAPDGSKVDAAEAFRIAGIEHGFFALQPKEGLAIVNGTAVGSGLAAIVLFEANVLAVLAEVLSAVYCEVMAGNPEYTDHLIHALKHHPGQIEAAAIMEHILEGSSYMRLAKEQGELDRLTKLRQDRYAIRTAPQWLGPQVEVIRFATKSIEREINSVNDNPVIDVARRKALHGGNFQGTPIGVSMDNTRLAIAAIGRLMFSQFSELASSFYSNGLPSNLSGGRNPSLDYGFNGAEVAMASYCSELQFLANPVTNHVQTAEQHNQSVNSLGLISSRMTAEAVTILKLMSSTFLIALCQAVDLRQLEESIKAAVNKCVTNVAKKSLAMDDDDLLALXXXXXXXLGAAIDRVAVFTYAEDPCRSSLPLIQKLRAVLMDHALANGDXXXXXXXXPAGQGGXVRAAAPRGAPRRGGGRTRGCGERHXAPNRITQCRSYPLYRFVRKELGAEYLTGEKTRSPGEEVDKVVIAMNQHKHINPLLECLSEWKGAPLPLN

SEQ ID NO: 605 - DNA, 2211 bp, Oryza sativa
atggagtgtgagaccggtctggtcgaccgtcccctcaacggcgaccccttgtactggggcaaggcggcggagggtcttgcggggagccacctcgacgaggtgaagaggatggtggtggagtaccgcgcgccgctggtgaagatcgacggcgccatgctcagcgtcgccaaggtggcagccgtcgctggcgaggccgcccgggtgcaggtggtgctggacgaatccgcacgaccccgcctggaggctagtcgcgagtgggtcttcgacagcaccatgaacggcaccgacacgtacggcgtcaccaccggcttcggaggtgccgcccaccgccgcaccaaggagttcgccgcgctccagaaagagctgatccggtagagatacctcaacgccggcgtctttggagccagccgcagcgacggctacacgctgccgacggaggtcactcgcgcagccatgctggtgcgcatcaacaccctcacccagggctactcgggcatccgcttcgagatcctcgaggccatcgccaagctgctcaacgccaacgtgacgccgtgcctgccgctccggggcaccatcaccgcgtccggcgacctggtcccgctgtcctacatcgccggcctcatcaccggccgccagaactccgcggcggtggccccggacggcagcaaggtggacgccgctgaggcgttcaggatcgccggcatcgagcacgggttcttcgcgttgcagcccaaggaagggctcgccatcgtcaacggcacggccgtgggctccggcctcgcggcgatcgtgctcttcgaggccaacgtcctggccgtccttgccgaggtcctctcggcggtgtactgcgaggtgatggccggcaatccggagtacaccgaccacctcatccacgcgctgaagcaccaccctggacagatcgaagctgcggccatcatggagcacatactggaaggcagctcctacatgaggcttgccaaggagcagggcgagcttgaccggttgacgaagctgaggcaggacaggtacgccatccgcacggcgccgcagtggctcggcccgcaggtcgaggtcatccgcttcgccaccaagtcgatcgagcgggagatcaactccgtcaacgacaacccggtcatcgacgtcgcccgccgcaaggcgctccacggcggcaacttccagggcactcccatcggggtgtccatggacaacactcgtctcgccatcgctgccatcggcaggctcatgttctcgcagttctccgagcttgccagtagcttctacagcaacggccttccctccaatctgtccggcgggcgcaacccgagcttggactacggtttcaatggcgccgaggtcgccatggcgtcctactgctctgagctgcagttcctcgccaacccggtgaccaaccatgtgcagaccgcggagcagcacaaccagagcgtcaactctctcggcctcatctcctccaggatgacagcagaggccgtcaccatcctgaagctcatgtcctctactttcctcatcgcactgtgccaggccgtcgacctgcgccaactcgaggagagcatcaaggccgctgttaacaagtgcgtgacaaatgtcgccaagaaatccctggccatggacgatgacgatctgctagcgctgctcggcgctgctatcgaccgcgtggcggtgttcacgtacgcagaagacccatgcagatccagcttgccactcatacagaagctccgcgcggtgctcatggaccatgcgctggccaacggtgacaaccagctggccaaggtggctgagttcgagcagcagctccgcgcggtgctccacgacgaggtggaggccgcacgcgcggctgtggagagcggcacggccccgaacaggatcacccagtgtcgctcgtacccgctgtacaggttcgtgcgcaaggagctcggcgccgagtacctgaccggcgagaagacgcggtcgcccggggaggaggtggacaaggtggtgatcgccatgaaccagcacaagcacatcaacccactgctggagtgcctcagcgagtggaaaggcgcgcccctgccacttaattagctcaactacgtacgtacaaataagagaagacgaggtgtacgtctgacggatgaaaaattatttaaagcaaaagtactatcctactatatatacccaataattcacgcggcgggccggggcgtaagtgaataa

SEQ ID NO: 606 - protein, 240 aa, Oryza sativa
MGGSEYDDDWELPSADITVVLCGKLGCGKSATGNSIVGREAFVSEYSHASVTSTCQLASTALKDGRTLNVIDTPGKEIVKCMSMAKDGIHAVLMVFSATSRFTREDSSTIETIKEFFGEKIVDHMILVFTYGDCKNRVVLFDNMTKDRWLQEKQLENLLDVVDSVNTNNGGGGKLNITVDKLQQQLMEEQNARLEAERLAAEARLRSDEEIRKLKKRLEKAQQENEEFRKMASQHKCSIL

SEQ ID NO: 607 - DNA, 725 bp, Oryza sativa
atgggaggaagcgaatacgatgatgactgggagttgcctagcgctgacatcactgtagttctttgcggcaaacttggctgtggcaagagcgcaactggcaatagcatcgttggaagagaagcatttgtatcagagtactcccatgctagtgtgaccagtacttgtcaattggccagcaccgcgctaaaggatggccgtaccctcaatgttattgatacgccagggtaaagaaattgttaagtgtatgagtatggccaaggatgggatacatgcagtgctgatggttttttctgccacatctcgttttactcgagaagattccagtaccattgagacaattaaagagtttttcggagagaagattgttgatcacatgatactagtatttacttatggagattgcaaaaacagagttgttctctttgataatatgaccaaggaccgatggctccaagagaagcaacttgaaaatttgcttgatgttgttgactctgtgaatacaaataatggaggtggaggaaaagctgaatatcactgttgacaagctgcaacagcaactcatggaagaacagaatgcaaggctagaagcagagaggttggcagctgaagctaggctccgatcagatgaggagatccgcaagctcaaaaagcgcctcgagaaggcccaacaagaaaatgaggaattccgaaagatggcttctcaacacaagtgttctattctatga

SEQ ID NO: 608 - protein, 702 aa, Oryza sativa
  misc_feature (120)..(120): Xaa = any naturally occuring amino acid
  misc_feature (364)..(364): Xaa = any naturally occuring amino acid
MSSVSAPPRADPLNWGKAADELAGSHLDEVKRMVEDFRQPLVKIEGASLTIAQVAAVAAGAGDARVELDESARGRVKASSDWVMNSMMNGTDSYGVTTGFGATSHRRTKEGGALQRELIXRFLNAGAFGTGTDGHVLPAEATRAAMLVRINTLLQGYSGIRFEILEAITKLLNANVTPCLPLRGTITASGDLVPLSYIAGLITGRQNSVAVAPDGRKVTAAEAFKIAGIEHGFFELQPKEGLAMVNGTAVGSGLASTVLFEANVLAILAEVLSAVFCEVMTGKPEYTDHLTHKLKHHPGQIEAAAIMEHILEGSSYMKLAKKLGELDPLMKPKQDRYALRTSPQWLGPQIEVIRFATKSIEREXNSVNDNPLIDVSRGKALHGGNFQGTPIGVSMDNTRLALAAIGKLMFAQFSELVNDFYNNGLPSNLSGGRNPSLDYGFKGAEIAMASYCSELQFLGNPVTNHVQSAEQHNQDVNSLGLISSRKTAEAIDILKLMSSTFLIALCQAIDLRHLEENMKTAVKNCVMQVAKKSLSMNHMGGLHIARFCEKDLLTAIDREAVFAYADDPCSANYPLMQKLRAVLIEHALANGDAERVLETSIFAKVAEFEQHVRAALPKEVEAARAAVENGTPLVPNRIKECRSYPLYRFVREEVGTEYLTGEKTRSPGEELNKVLVAINERKHIDPLLECLKEWNGAPLPLC

SEQ ID NO: 609 - DNA, 2108 bp, Oryza sativa
  misc_feature (1089)..(1089): w = adenine or thymine
  misc_feature (1904)..(1904): m = adenine or cytosine
atgtcgtcggtgtcggcgccgccgcgggccgacccactgaactgggggaaggcggcggacgagctggcggggagccacctcgacgaggtgaagcggatggtggaggacttccgccagccgctggtgaagatcgagggcgccagcctgacgatcgcgcaggtggccgccgtggccgccggcgccggcgacgccagggtggagctcgacgagtccgcccgcggccgcgtcaaggccagcagcgactgggtcatgaacagcatgatgaacggcaccgacagctacggcgtcaccaccggcttcggcgccacctcccaccgccgcaccaaggagggcggcgcgctccagagggagctcatcagagattcctcaatgccggcgccttcggcaccggcaccgacggccacgttctgccggcggaggcgacgcgcgcggcgatgctcgtccgcatcaacaccctcctccagggttactccggcatccgcttcgagatcctcgaggccatcaccaagctgctcaatgccaacgtcacgccgtgcctgccgctccggggcaccatcaccgcctccggtgacttggtcccactgtcctacattgccggcctcatcaccggccgccagaactccgtggccgtcgccccggatggccgcaaggtgaccgccgccgaggcattcaagattgccggcattgagcacggcttcttcgagttgcagcctaaggaaggtcttgccatggtgaacggcactgccgtcggctctggccttgcatcgaccgtgctctttgaggccaacgtccttgccatcctcgccgaggtcctgtccgccgtgttctgtgaggtcatgaccggcaagccggagtacaccgaccacctgacacacaagctgaagcaccaccctggacagatcgaggctgccgccatcatggagcacatcttggaaggcagctcgtacatgaagctggcgaagaagctcggcgagctcgacccgttgatgaagccgaagcaggacaggtacgcgctccgcacgtcgccgcagtggctcggcccacagatcgaggtcatccgcttcgccaccaagtcgatcgagcgcgagwtcaactccgtcaacgacaacccgctgatcgatgtctcccgtggcaaggcgcttcacggtggcaacttccagggcacgcccatcggcgtgtccatggacaacacccgcctcgccctcgctgccatcggcaagctcatgttcgcgcagttctctgagctcgtgaacgacttctacaacaacgggcttccttccaacctgtccggtggacgcaaccccagcttggactatgggttcaagggcgcggagatcgccatggcgtcgtactgctccgagctccagttcttgggcaacccggtgaccaaccatgtccagagcgcggagcagcacaaccaggacgtgaactcgcttggtctcatctcctccaggaagaccgccgaggccatcgacatcctgaagctcatgtcctccacgttcttgatcgccctgtgccaagccatcgacctgcgccacctcgaggagaacatgaagaccgcggtgaagaactgcgtgatgcaggtggccaagaaatccctgagcatgaaccacatgggcggcctccacatcgctcgcttctgcgagaaggacctgctcaccgcgatcgaccgcgaggccgtgttcgcctacgccgacgacccctgcagcgccaactacccgttgatgcagaagctccgcgcggtgctcatcgagcacgcgctcgccaacggcgacgccgagcgcgtcctggagacctccatcttcgccaaggtggccgagttcgagcagcacgtccgcgccgcgctgcccaaggaggtggaggccgcccgcgccgccgtcgagaacggcaccccgctcgtcccmaaccggatcaaggagtgccgctcgtacccgctctaccggttcgtgcgcgaggaggtcggcaccgagtacctcaccggcgagaagacgcggtcgcccggcgaggagctgaacaaggtgctcgtcgccatcaacgagcgcaagcacatcgacccgctgctcgaatgcctcaaggaatggaatggcgcgccactgccactctgctga

SEQ ID NO: 610 - protein, 760 aa, Oryza sativa
  misc_feature (122)..(122): Xaa = any naturally occuring amino acid
MAGNGPINKEDPLNWGAAAAEMAGSHLDEVKRMVAQFREPLVKIQGATLRVGQVAAVAQAKDAAGVAVELDEEARPRVKASSEWILNCIAHGGDIYGVTTGFGGTSHRRTKDGPALQVELLXRHLNAGIFGTGSDGHTLPSETVRAAMLVRINTLLQGYSGIRFEILEAITKLLNTGVTPCLPLRGTITASGDLVPLSYIAGLITGRPNAQAISPDGRKVDAAEAFKLAGIEGGFFTLNPKEGLAIVNGTSVGSALAATVMFDANILAVLSEVLSAVFCEVMNGKPEYTDHLTHKLKHHPGSIEAAAIMEHILAGSSFMSHAKKVNEMDPLLKPKQDRYALRTSPQWLGPQIEVIRAATKSIEREVNSVNDNPVIDVHRGKALHGGNFQGTPIGVSMDNARLAIANIGKLMFAQFSELVNEFYNNGLTSNLAGSRNPSLDYGFKGTEIAMASYCSELQYLANPITNHVQSAEQHNQDVNSLGLVSARKTLEAVDILKLMTSTYIVALCQAVDLRHLEENIKSSVKNCVTQVAKKVLTMNPTGDLSSARFSEKNLLTAIDREAVFSYADDPCSANYPLMQKLRAVLVEHALTSGDRRARGLRVLQDHQVRGGAPLCAAPGDRGRPRRRRQRTAPVANRIVESRSFPLYRFVREELGCVFLTGEKLKSPGEECNKVFLGISQGKLIDPMLDCLKEWNGEPPSHQSTKPRSHRHCHCHTPIIEEERRLKIKENEPLRVSSDKKDPVFSSFVAVWFIVISCSLC

SEQ ID NO: 611 - DNA, 2282 bp, Oryza sativa
atggcgggcaacgggccgatcaacaaggaggacccgctcaactggggcgcggcggcggccgagatggccggcagccacctcgacgaggtgaagcgcatggtggcgcagttccgcgagccgctggtcaagatccagggcgccaccctccgcgtcggccaggtggccgccgtcgcccaggccaaggacgccgccggcgtcgccgtcgagctcgacgaggaggcccgcccccgcgtcaaggccagcagcgagtggatcctcaactgcatcgcccacggcggcgacatctacggcgtcaccaccggcttcggcggcacctcccaccgccgcaccaaggacggccccgccctccaagtcgagctcctcagaggcatctcaacgccggaatcttcggcactggctccgatggccacacgctgccgtcggagacggtgcgggcggccatgctcgtgcgcatcaacaccctcctccagggctactccggcatccggttcgagatcctcgaggccatcaccaagctgctcaacaccggcgtcacgccgtgcctgccgctccgtggcaccatcaccgcgtccggtgacctggttcccctgtcctacattgccggcctcatcaccggccgccccaacgcgcaggccatctcgcccgacggcaggaaggtggacgccgccgaggcgttcaagctcgccggcatcgagggtggcttcttcacgctgaaccccaaggaaggtctcgccatcgtcaatggcacgtccgtggggtcggcgctcgcggccaccgtgatgttcgacgccaacatcctcgccgtcctgtccgaggtgctctcggcggtgttctgcgaggtgatgaacggcaagccggagtacaccgaccacctgacccacaagctgaagcaccaccctgggtcgatcgaggccgccgccatcatggagcacatcctcgccgggagctcgttcatgagccacgccaagaaggtgaacgagatggacccgctgctgaagccgaagcaggacaggtacgcgctccgcacgtcgccgcagtggctcggcccgcagatcgaggtcatccgcgccgccaccaagtccatcgagcgcgaggtcaactccgtgaacgacaacccggtgatcgacgtccaccgcggcaaggcgctccacggcggcaacttccagggcacccccatcggtgtgtccatggacaacgcccgtctcgccatcgccaacatcggcaagctcatgttcgcgcagttctccgagctcgtgaacgagttctacaacaacgggctgacctccaacctggccggcagccgcaacccgagcttggactacgggttcaagggcaccgagatcgccatggcctcctactgctctgagctccagtacctcgccaaccccatcaccaaccatgtccagagcgcggagcagcacaaccaggacgtgaactcgctgggtctcgtctcggccaggaagaccctggaggcggtggacatcctcaagctcatgacctccacctacatcgtcgccctgtgccaggccgtcgaccttcgccacctcgaggagaacatcaagagctccgtcaagaactgcgttacccaggtggccaagaaggtgctcaccatgaaccccaccggcgacctctccagcgcgcgcttcagcgagaagaacctccttaccgccatcgaccgcgaggccgtgttcagctatgccgacgacccgtgcagcgccaactacccgctcatgcagaagctccgcgccgtgctcgtcgagcacgccctcaccagcggcgacgccgagcccgaggcctccgtgttctccaagatcaccaagttcgaggaggagctccgctctgcgctgccccgggagatcgaggccgcccgcgtcgccgtcgccaacggcaccgcccccgtcgccaaccggatcgtcgagagccggtcgttcccgctctaccgcttcgtccgcgaggagctcggctgcgtattcctcaccggcgagaagctcaagtcccccggcgaggagtgcaacaaggtgttcctcggcatcagccagggcaagctcatcgaccccatgctcgactgcctcaaggagtggaacggcgagcccccttcccaccaatcaactaagccaagatcccatcgccattgccattgccatacacccatcatcgaggaggagaggagactaaaaataaaagaaaacgaaccgcttcgtgtatcttcagacaaaaaagaccctgtattttcttcgttcgttgccgtttggtttatagtgatctcgtgttctttgtgttag

SEQ ID NO: 612 - protein, 713 aa, Oryza sativa
MACENGQVAADGINGLCMAAPRADPLNWGKAAEEMSGSHLDEVKRMVAEYRQPLVKIEGASLRIAQVAAVAAAGEARVELDESARERVKASSDWVMNSMMNGTDSYGVTTGFGATSHRRTKEGGALQRELIRFLNAGAFGTGTDGHVLSAEATRAAMLVRINTLLQGYSGIRFEILEAITKLLNANVTPCLPLRGTVTASGDLVPLSYIAGLVTGRENSVAVAPDGSKVNAAEAFKIAGIQGGFFELQPKEGLAMVNGTAVGSGLASTVLFEANILAVLAEVLSAVFCEVMNGKPEYTDHLTHKLKHHPGQIEAAAIMEHILEGSSYMKLAKKLGELDPLMKPKQDRYALRTSPQWLGPQIEVIRAATKSIEREINSVNDNPLIDVSRDKALHGGNFQGTPIGVSMDNTRLAIAAIGKLMFAQFSELVNDYYNNGLPSNLSGGRNPSLDYGFKGAEIAMASYCSELQFLGNPVTNHVQSAEQHNQDVNSLGLISSRKTAEAVEILKLMSSTFLVALCQAIDLRQIEENVKSAVKSCVMTVARKTLSTSATGGLHAARFCEKDLLQEIDREAVFAYADDPCSANYPLMKKLRNVLVERALANGAAEFNAETSVFAKVAQFEEELRAALPAAVLAARAAVENGTAATPNRITECRSYPMYRFVREELGTAYLTGEKTRSPGEELNKVLVAINQGKHIDPLLECLKEWNGAPLPIC

SEQ ID NO: 613 - DNA, 2142 bp, Oryza sativa
  misc_feature (1969)..(1969): m = adenine or cytosine
atggcgtgcgagaacggtcaggttgctgccgatggcatcaacggcctctgcatggcggcgccccgcgccgacccgctgaactgggggaaggcggcggaggagatgtcggggagccacctcgacgaggtgaagcgcatggtggccgagtaccgccagccgctggtaaagatcgagggcgccagcctgaggatcgcgcaggtcgccgcggtggccgcggccggcgaggccagggtcgagctcgacgagtcggcccgcgagcgcgtcaaggccagcagcgactgggtgatgaacagcatgatgaacggcacggacagctacggtgtcaccaccggcttcggcgccacgtcccacaggaggaccaaggaaggtggtgccctgcaaagagagctcatcaggttcctcaatgccggcgccttcggcacgggcacggacggccacgtcctgtccgccgaggccacgcgcgcggcgatgctcgtccgcatcaacactctcctccagggctactcaggcatccgcttcgagatcctcgaggcgattaccaagctgctcaatgccaacgtcacgccatgcctgccactcaggggcacggttaccgcgtccggcgacctggtcccgctctcctacattgccggcttggtcaccggccgcgagaactctgtcgcggtcgctcctgatggcagcaaggtgaacgccgctgaggcgtttaagattgctggcatccaaggtggcttcttcgagttgcagcccaaggaaggtctcgccatggtgaatggcactgccgtcggctctggacttgcctccacggtgctctttgaggcgaacattcttgctgtccttgccgaggtcctgtccgccgtgttctgcgaggtgatgaacggcaagccggagtacaccgaccacctgacacacaagctgaagcaccaccctggacagatcgaggctgctgccatcatggagcacatcttggaaggcagctcgtacatgaagctggcgaagaagctcggtgagctcgacccgttgatgaagccgaagcaagaccggtacgcgctccgcacgtcgccgcaatggcttggccctcagatcgaagttattcgtgcggccaccaagtccattgagcgcgagatcaactctgtcaatgacaacccactcattgatgtctcccgcgacaaggcgcttcatggtggtaacttccagggcactcccatcggtgtgtccatggacaacactcgcctcgcaattgctgccatcggcaagctcatgttcgcgcagttctcagagcttgtgaacgactactacaacaacggccttccctccaacctgtccggcgggcgcaacccgagcttggattacggcttcaagggcgccgagatcgccatggcttcgtactgctccgagttgcagttcttgggcaacccagtgaccaaccacgtccagagcgcggagcagcacaaccaggacgtcaactccctcggcctcatctcctccaggaagacagccgaggccgtcgaaatcctgaagctcatgtcctccacgttcttggtcgccctgtgccaggccatcgacctgcggcaaatcgaggagaacgtcaagagcgccgtcaagagctgcgtcatgacagtggccaggaagactctgagcacgagcgccaccggcggtctccacgccgctcgcttctgcgagaaggatcttctccaggagatcgaccgcgaagccgtgttcgcgtacgccgacgacccgtgcagcgccaactacccgctgatgaagaagctccggaacgtgcttgtggagcgcgccctcgccaacggcgcggccgagttcaacgccgagacctcggtgttcgccaaggtcgcccagttcgaggaggagctccgcgcggcgctgccagcggcggtgttggccgcacgggcagctgtggagaacggcacggcggcaacgcccaacagaatcaccgagtgccgctcctacccamtgtaccggtttgtgcgcgaggagctcggaaccgcgtacctcaccggcgagaagacgcggtcgcccggcgaggagctgaacaaggtgctcgtcgccatcaaccaaggcaagcacattgatccgctgcttgagtgtctcaaggagtggaacggcgcgcccctgcccatctgctaa

SEQ ID NO: 614 - protein, 774 aa, Oryza sativa
MMQRPFRPEEYSLKETSPHLGGGAAGDKLTTTYDLVEQMQYLYVRVVKAKDLPSKDITGSCDPYVEVKLGNYRGTTRHFEKKTNPEWNQVFAFSKERIQSSVVEIIVKDKDFVKDDFIGRVLFDLNEVPKRVPPDSPLAPQWYRLEERNGHKVKGELMLAVWMGTQADEAFPEAWHSDAASIPGDGLASIRSKVYLTPKLWYLRVNVIEAQDLIPNDRTRFPDVYVKAMLGNQALRTRVSPSRTLNPMWNEDLMFVAAEPFEEHLILSVEDRIAPGKDDVLGRTIISLQHVPRRLDHKLLNSQWYNLEKHVIVDGEQKKETKFSSRIHLRICLEGGYHVLDESTHYSSDLRPTAKQLWKHSIGILELGILTAQGLLPMKTKDGRGTTDAYCVAKYGQKWVRTRTIIDSFTPKWNEQYTWEVYDPCTVITIGVFDNCHLNGGEKANGARDTRIGKVRIRLSTLETDRVYTHAYPLIVLTPAGVKKMGEVQLAVRFTCSSLLNMMHLYSQPLLPKMHYVHPLSVMQVDNLRRQATNIVSTRLSRAEPPLRKEIVEYMLDVDSHMWSMRKSKANFFRIMGVLSPLIAVAKWFDQICHWRNPLTTILIHILFVILVLYPELILPTIFLYLFLIGVWYYRWRPRQPPHMDTRLSHAESAHPDELDEEFDTFPTSRPPDIVRMRYDRLRSVAGRIQTVVGDLATQGERLQSLLSWRDPRATALFVTFCFVAAIVLYVTPFRVVVFLAGLYTLRHPRFRHKMPSVPLNFFRRLPARTDSML

SEQ ID NO: 615 - DNA, 2325 bp, Oryza sativa
  misc_feature (218)..(218): r = adenine or guanine
atgatgcagaggccgttccgtccggaggagtactccttgaaggagacttctcctcaccttggtggtggagctgctggtgacaagctcaccaccacctatgacttggttgagcagatgcagtatctttatgtccgggtagtaaaagctaaggaccttccaagcaaggacatcactggaagctgtgacccatatgttgaggtgaagcttgggaattatargggtacaactcggcatttcgagaagaagactaatcctgagtggaaccaggtctttgccttttctaaggagcgcattcagtcatcagtggttgagatcattgtcaaggataaggactttgtcaaggatgacttcatcgggcgggtgttgtttgacctgaatgaggtcccaaaacgagtgccacctgacagcccattggctccacagtggtatcggttggaagagcggaatggacacaaggtgaagggagagttgatgttggccgtttggatgggtactcaagcagatgaagcattccctgaagcttggcactctgatgcagcgtcgatcccaggagatggacttgcaagtattagatcaaaagtttaccttactccaaagctttggtatctgagagtcaatgtcattgaggcacaagatcttataccaaatgacaggaccaggttccctgatgtttatgtcaaagccatgctaggtaaccaagctcttagaacccgggtatcaccaagccggacgctgaatccaatgtggaatgaggatttaatgtttgttgctgctgaaccattcgaggaacacctgattctgagtgtagaagataggattgccccagggaaggatgatgtacttggaaggacaatcatttctctgcagcacgtacctcggaggctggatcacaagttgctgaacagccagtggtacaatcttgagaagcatgtaattgtggatggcgagcagaagaaagagaccaaattttcaagccggattcacttgagaatatgcctcgaaggtggatatcatgtcttggatgagtcaacacattacagcagtgatttgaggccaactgctaaacagttatggaagcacagcattggcattcttgagttgggtatcttgacagcacagggcctgttgccgatgaagaccaaggatgggcgtggaacaactgatgcttattgtgttgctaagtatgggcagaagtgggtgcggacaaggactattattgatagtttcacacccaagtggaatgaacaatacacttgggaggtgtatgatccctgcactgtgatcactattggtgtatttgacaattgccacttgaatggtggggaaaaagccaacggtgcccgggataccagaattgggaaggtccgcatccgcctctctacgctagaaactgatcgagtatatactcatgcttaccctctgattgttctgacacctgctggtgttaagaaaatgggggaggtgcagcttgctgtcaggttcacatgctcatcactgctgaacatgatgcatctgtattcacaaccattgctgcccaagatgcactatgtacacccattgtccgtgatgcaggtagacaatctaaggcgccaagccaccaacattgtatcaacaaggctgagccgtgcagaaccaccactgcggaaggaaattgtggagtacatgctggatgttgactctcatatgtggagcatgcggaagagcaaggcaaactttttccgtatcatgggtgtcctaagccctctgattgcggtggccaagtggtttgatcagatctgccattggagaaatccgctgaccaccatactgatccacattctctttgtgattttagtcttgtatcctgagctgatactgccaacaatcttcctctacctgttcctgattggagtgtggtactaccgctggcggccaaggcagccacctcacatggacactcgcctctcacatgcggagagtgctcatcctgatgagcttgatgaagagtttgacacattccctacttctcgtccgcctgacattgtgaggatgcgttatgaccggctacggagtgttgctgggaggatacagaccgtagtcggcgatctcgcgacacaaggagaaaggctgcagtccctgctaagctggagagacccaagagccacggcgctctttgtgaccttctgctttgttgctgccattgtcctctacgtgactccattccgtgttgtggtcttccttgcaggcctgtacaccttgagacacccaaggttccgccacaagatgccctctgttcctctgaacttcttcaggaggctccctgcaagaactgatagcatgttgtaa

SEQ ID NO: 616 - protein, 553 aa, Oryza sativa
  misc_feature (66)..(72): Xaa = any naturally occuring amino acid
  misc_feature (283)..(283): Xaa = any naturally occuring amino acid
  misc_feature (342)..(342): Xaa = any naturally occuring amino acid
  misc_feature (346)..(346): Xaa = any naturally occuring amino acid
  misc_feature (351)..(351): Xaa = any naturally occuring amino acid
MDVRRGGGGGRIVGAARRALTWGALPLPMRITNGLAMVSLVLSSCDLLRLCSDRERPLGGREFATXXXXXXXVVYLVSLFAHPDAPATTTGDDDDGQGGSRRAAPPPREPAPMHGHGGGMMEADDEEIVAAVASGALPSHRLESRLGDCRRAARLRREALRRVTGRGVEGLPFDGMDYQAILGQCCEMPVGYVQLPVGVAGPLLLDGREYHVPMATTEGCLVASVNRRVQGHLASGGAFSVLLRDAMSRAPAVKLPSAMRAAELKAFAEAPANFELLAAVFNXRSSRFGRLQDIRCALAGRNLYMRFSCITGDAMGMNMVSKGVENVWGYLQNVFPDMDVIXVSGXNSSPXTLHASSGNYCSDKKPTAVNWIEGRGKSVVCEAIIKGDVVQKVLKTTVEKLVELNIIKNLAGSAVAGALGGFNAHASNIVTALFIATGQDPAQNVESSQCITMLEEVNDGDDLHISVTMPSIEVGTIGGGTCLASQAACLNLLGVKGSNHGSPGANAKRLATIVAGSVLAGELSLLAALASGHLVKSHMMYNRSSKDVAKAAS

SEQ ID NO: 617 - DNA, 1640 bp, Oryza sativa
  misc_feature (1002)..(1002): r = adenine or guanine
  misc_feature (1010)..(1010): k = guanine or thymine
  misc_feature (1016)..(1016): w = adenine or thymine
atggacgtgcgccggggcgggggcggagggcgcatcgtcggggcggcgcggagggcgctcacctggggggcgctgcccctcccgatgcggatcaccaacggcctggccatggtctccctcgtgctctcctcctgcgacctgctccgcctctgcagcgacagggagcggcccctcggcggccgggagttcgccaccgtcgtctacctcgtcagcctcttcgcccaccctgacgcccccgccaccaccaccggcgacgacgacgacggccaggggggctcccgccgcgcgcgccccgccgccgcggagcccgcgccaatgcatgggcatggtggcgggatgatggaggccgacgacgaggagatcgtcgccgcggtggcgtccggcgcgctgccgtcgcaccgcctggagtcgcggctcggggactgccgccgcgcggcgaggctgaggcgggaggcgctgcggcgggtgacggggcggggagtggagggcctccccttcgatgggatggactaccaggccatcctggggcaatgctgcgagatgcccgtcgggtacgtgcagctccccgtgggggtcgccggcccgctgctcctggacggccgcgagtaccatgtccccatggctaccaccgagggatgcctcgtcgccagcgtcaaccgcgggtgcagggccatctccgcttccggcggcgccttcagcgttctgctccgggacgccatgtcccgcgctcctgctgtcaagctgccttccgcaatgcgggcagcggagctcaaggcgtttgctgaggcgcctgcgaattttgagttgctggctgctgtcttcaatagaggtccagcagatttggtaggcttcaagacattcgttgtgcactcgctgggaggaacctatatatgagatttagctgtatcactggagatgctatgggaatgaacatggtgtcaaaaggtgttgagaatgtctggggctatctgcagaatgtcttccctgacatggatgtcatcrgcgtatckggtttwaactcttccccttgaactttgcatgcttcatcaggtaactattgctcagacaagaagccgacagctgtaaactggatagaaggccgggggaaatctgttgtttgtgaggctattattaaaggagatgttgtgcagaaagttcttaagacgactgtagaaaaacttgttgagcttaacattatcaaaaatcttgctggatcagctgtagctggggctcttgggggttttaatgcccatgcgagtaatattgttactgcattattcattgctacaggacaggatcctgcacaaaatgttgaaagctcacaatgcatcaccatgttggaagaagtaaatgatggagatgatcttcatatctctgtcaccatgccgtccattgaggtaggtacaatcggaggtggtacatgtctggcctcacaggcggcttgtttgaacctgcttggtgtcaagggttcaaatcatggctcacctggtgcaaatgctaaacgtttggctaccatagtagctggcagcgtgctcgctggcgagctctcgctccttgccgctcttgcctctggtcaccttgtcaagagccacatgatgtacaatcgatcaagtaaggatgtcgccaaggctgcttcttga

SEQ ID NO: 618 - protein, 505 aa, Oryza sativa
  misc_feature (306)..(306): Xaa = any naturally occuring amino acid
  misc_feature (392)..(392): Xaa = any naturally occuring amino acid
MEAMDELVQLAESMRQAASLLADEDPSDEASPRRPSTFLKRRRARQRGAGKSAVLNSLIGHPVLQPTGENGATRAPIVVDLQRDPGLSSKSIVLQIDSKSQQVSASGALRHSLQDRLSKGASGGSGKGRNDEIYLKLRTSTGAPPIKLVDLPGIDQRVMDDSTISEYAGHNDAILIVVIPAMQAADVASSRALRLAKDIDPDTRTIGVLSKIDQASADAKTVSCVQAILSNKGALIGQSVSIASAQAGSVGSENSLETAWQAEAETLKSILTGAPRSKLGRIALVDTIAKQIRKRMKIRLPNLLSXLQGKSQIVQNELARLGEQMVSSAEGTRAVALELCREFEDKFLAHVTSGEGSGWKIVASFEGKFPDRIKQLPLDRHFDINNVKRVLXEADGYQPYLISPEKGLKSLIKGVLEMAKEPSRLCVEEVHRVLLDIVNASANATPGLGRYPPFKREVVEIATNALDVFKSDAKKMVVALVDMERAFVPPQHFIRLVQRREWKGN

SEQ ID NO: 619 - DNA, 2500 bp, Oryza sativa
atggaggccatggacgagctcgtccagctcgccgagtccatgcgccaggccgcctccctcctggccgacgaagacccctccgacgaggccagcccgcgccgcccctccaccttcctcaaacgccgtcgcgctcggcaacgtcggcgccggcaagtcggccgtgctcaacagcctcatcggccaccccgtgctgcagccgacgggtgagaacggggcgacgcgggcgccgatagtggtcgacctgcagagggatccggggctgagcagcaaatccatcgtcctgcagatcgacagcaagtcgcagcaggtgtcggcaagcaggtgctctccgccattcgctgcaggacaggctgagcaagggggcgtccggtggatcagggaaaggccgaaacgatgagatttacctcaagctgcggacaagtacaggctcctccaataaaattggtcgatttgcctggcatagaccaacgagttatggatgattcaactatcagtgaatatgctggacataatgatgcaatattgattgttgtgataccagcaatgcaagctgctgatgttgcatcatctcgagctctcagactagcgaaggatattgatccagatgaccagaacaataggtgttttaagtaaaattgatcaagcatctgcagatgcaaaaactgtatcttgtgttcaggctatcttgtctaacaagggtgctctaatagggcaatctgtctcaattgcatcggcccaagctggatcagttggttctgagaactcactggaaactgcctggcaggctgaagcggagacactcaaatccatcctaactggagctcctcgaagtaagctagggagaattgctctcgtggataccattgctaagcagatacgtaaaaggatgaaaattcggctacctaaccttttgtccggcttcaggggaagtctcagatagtgcaaaatgaacttgcaaggttgggagaacagatggtatcaagcgctgaaggaaccagggctgttgctttggagctttgccgtgaattcgaagacaagtttcttgcccatgttacttctggtgaggggtctggttggaaaattgttgcaagctttgaggggaagtttccagataggatcaaacagcttcctttggacaggcattttgatattaacaatgtcaaaagggtcctggaagccgatggttatcaaccatatttgatatctccagagaaaggtttaaaatccttaataaaaggagtacttgaaatggcaaaggagccatcacggctgtgtgttgaagaggtacaccgtgtattattggacatagtaaatgcttctgcaaatgctacaccaggacttggaagatatcctccattcaaacgcgaggtcgttgaaattgcaaccaatgcattggatgtcttcaaaagtgatgcaaaaaagatggtagttgcacttgttgatatggagcgtgcctttgtcccaccacaacacttcatccgtttagtacaaagaagagaatggaaaggcaacgtcgtgaggatgaggtgaaaaacaggtcatctaagaaagcccaagatgcagaacagtccaacaagtggtggtgccttgaaatcgttgaaagaaaaattcagtcagcaagacaaagataaagatgcaaaagagggaccaaatttgcaggttgctgggcctggtggtgaaataactgcagggctaccttttgaagaaaagtgcaaaaaataatgaatggagcaaaagatggtttgtcctaaatgagaagagtggaaagcttgggtacaccaagaaacaagaggagagacattttcgaggtgttattgtcctggaggaatgtaatctggaagagatagaagaggaagagctttccaagagtttgaaggattcaaagaaggccaatggggcagagaaaggcccaagtcttgtatttaagattactaacagagttgcctacaaaactgtgctgaaatctgaaggccgagactattgctgacaaggttgaatggatgaagaaggatacgatggcccggaagcctgctgatcctgaagaagaacttcggtggatgtctcaagaagttcgtggttatgtagaggctgttttgaacagtttggcagcaaatgttccaaaggcaatcgtactttgccaagtggagaaagcaaaggaagatatgctaaatcagctctacagcaaaatagattagtgctcaaaccaatgcaaagattgaagaacttctccaagaggaccacaatgctaaacgtagacgggagaagtaccaaaaacaatcatctctattgtcaaagcttactcgtcagcttagtatccatgacaatagagcttctgttgcatcgtataccaatgatagttctggagctggagagtagcccacggacctctggccagtcaggtgaggactggaggtctgcgttcgattctgcatcaaatggctctggcagccgacgcacaccaaaccgtttgccaccagcacctccagggcaaaaatattaa

SEQ ID NO: 620 - protein, 247 aa, Oryza sativa
MARPSLPCAVVAVLLLALLPTPSTAGDPDLLQDICVADLTSGFVKEFICLVLRSSKIRLQKINLFGAAVKVNGFACKAAVTEDDFYFKGLAAAGNTNNTYGSVVTGANVEKLPGLNTLGVSMSRIDYAPGGLNPPHTHPRATEMVFVLQGTLDVGFITTANKLYTKTISAGDVFVFPRGLLHFQKNNGDTPAAVISAFNSQLPGTQSLAMTLFAASPEVPDGVLTKAFQVGTKEVEKIKSRLAPKKR

SEQ ID NO: 621 - DNA, 744 bp, Oryza sativa
atggctaggccttctctcccgtgtgccgtcgtggccgtcctcctcctcgccctcctccccacgccgtccaccgccggcgaccctgacctgctccaggacatctgcgtcgctgacctcacctcaggttttgtcaaagaatttatttgtcttgttctccgatcgagcaagattagattacagaaaataaatttgtttggtgcagccgtgaaggtgaatgggttcgcgtgcaaggcggcggtgacggaggacgacttctacttcaaggggcttgccgccgccggcaacaccaacaacacgtacggctcggtggtgaccggcgccaacgtggagaagttgccggggctcaacaccctgggcgtgtccatgtcccggatcgactacgcccccggcggcctcaacccgccgcacacccacccgcgcgccaccgagatggtgttcgtcctgcagggcaccctcgacgtcggcttcatcaccaccgccaacaagctgtacaccaagaccatctctgccggcgacgtcttcgtcttcccgcgcggcctgctccacttccagaagaacaacggcgacacccccgccgccgtcatctccgccttcaacagccagctgcccggcacgcagtccctcgccatgacgctcttcgcggcgtcgccggaggtgcccgacggcgtgctcaccaaggccttccaggttggcaccaaggaggtggagaagatcaaatccaggcttgcacccaagaagagataa

SEQ ID NO: 622 - protein, 223 aa, Oryza sativa
MAKLILATFAVVFMALAATSLAGDPDMLQDVCVADYKSLKGPLRLNGFPCKRIENVTANDFFFDGLMKAGNTGNAVGSVVTAASVESLPGLNTMGVSMARIDYAPWGLNPPHTHPRATEIIFVVEGSLDVGFVTTANKLFTRTVCKGEVFVFPRGLVHFQKNNGNTPAFAIAALNSQLPGTQSIAAALFGAAPPLPSDTLARAFQVDGGMVEFIKSKFVPPKY

SEQ ID NO: 623 - DNA, 672 bp, Oryza sativa
atggccaagctgatcctcgccaccttcgccgtcgtgttcatggcgctcgccgccacctccctcgccggcgacccggacatgctccaggacgtctgcgtcgccgactacaagtccctcaaaggcccgctgcggctgaacgggttcccgtgcaagaggatagagaacgtgacggcgaacgacttcttcttcgatgggctgatgaaggccgggaacacggggaacgcggtggggtcggtggtgacggcggcgagcgtggagagcctgccggggctgaacacgatgggggtgtccatggcgcgtatcgactacgcgccatgggggctgaacccaccgcacacgcatccccgtgccaccgagatcatcttcgtcgtcgagggctccctcgacgtcggcttcgtcaccaccgccaacaagctcttcacccgcaccgtctgcaagggggaggtgttcgtcttcccgcgggggctcgtccacttccagaagaacaacggcaacacgccggcgttcgccatcgccgccttgaacagccagctccccgggacgcagtccatcgccgccgcgctcttcggcgccgcgccgccgctgccgtcggacacgctggccagggcgttccaggtcgacggcggcatggtcgagttcatcaagtccaagttcgtcccgcccaaatactag

SEQ ID NO: 624 - protein, 511 aa, Oryza sativa
  misc_feature (18)..(18): Xaa = any naturally occuring amino acid
  misc_feature (303)..(303): Xaa = any naturally occuring amino acid
MEAIEELSELADATRQAXALLADDDPSEQPAQRRGGSSFLTVVALGNIVGAGKSAVLNGLIGHPVLPTGENGATRAPICVDLQRDASLSSKSIMLQIDSKSQQVSATRHSLQDRLTKAGSFGKGRSEEINVKLCTSTAPPLKLIDLPGIDQRSMDESMNDAILLVIVPALQAPDVASSRALRIARELDSEGGSRTIGVVSKVDQVAEDQRALLAVQALLVNQGPRTAADIQWIATIGNSVPIASVQSGVGSESSPETIWKVEVESLKSILLGSPQSKLGREALVDSLAKQIRTRIKVRLPNLXEWLQGKSQIIQEELAKLGEQMVQSSEGTRVIALGLCREFEDKFLQHITGVEGGGWKVVASFEGKFPTRIKQLPLDKHFDMKNVKRIVLEADGYQPYLISPEKGLRSLIKGLLELAKEPSILLVDEVHRVLLDIVSATANATPGLGRYPLFKRERKVIAIGSAALDGFKDEAKKMVIALVDMERAFVPPQHFIRLLQRREWKGNVTKMS

SEQ ID NO: 625 - DNA, 453 bp, Oryza sativa
atggccatggcgatgagaagggtggtgctggtggcggcggtgctgtgcgcggtggtcgccatggtcacagcgcaggaggcatccaacgtgcgcgccacgtatcactactatcgccccgcgcagaacaactgggacttaggagccccagccgtgagcgcgtattgtgctacgtgggacgctaacaagccactgtcgtggcgtcagaagtatggctggactgccttttgcgggcccgttggtcctaggggtcaggctgcatgtggcaagtgccttctggtgacgaacacggcgacgggggcgcagatcacggcgaggatcgtggaccagtgcgccaatggcggccttgacctggactgggacaccgtcttcaccaagatcgacaccgacggccagggctaccagaagggccacctcatcgtcaactacaagttcgtcgactgcggcgacaactga

SEQ ID NO: 626 - protein, 150 aa, Oryza sativa
MAMAMRRVVLVAAVLCAVVAMVTAQEASNVRATYHYYRPAQNNWDLGAPAVSAYCATWDANKPLSWRQKYGWTAFCGPVGPRGQAACGKCLLVTNTATGAQITARIVDQCANGGLDLDWDTVFTKIDTDGQGYQKGHLIVNYKFVDCGDN

SEQ ID NO: 627 - DNA, 906 bp, Oryza sativa
atggctgctaataagctcaagttctcccctctccttgccctcttcctcctcgccggcatagccgtcacctcccgtgccggcgacatcgccgtgtactggggccagaacggcgacgagggcagcctggccgacgcctgcaactccggcctatacgcgtacgtcatggtcgccttcctcagcaccttcggcaacggccagacccctgtcctcaacctcgccgggcactgcgaaccaagctccggcggctgcaccggccagagctcggacatccagacgtgccagtcgctgggcgtcaaggtcatcctgtccatcggcggcggcgccggcagctacgggctgtcgtccacccaggacgcccaggacgtggccgactacctgtggaacaacttcctcggcggcagctcgggctcccggccgctcggcgacgccgtgctggacggcgtcgacttcgacatcgagaccggcaacccggcgcactacgacgagctcgccacgttcctgtcgcggtacagcgcgcagggggcggcaaagaaggtgatcctgacggcggcgccgcagtgcccctacccggacgcgtcgctggggccggcgctgcagacggggctgttcgacagcgtgtgggtgcaatttctacaaccaacccgccgtgccagtacgccaacggcgacgcccagcaacctggtgagcgcgtggaacacgtggaccggcggcgtcagcgccgggagcttctacgtcggcgtgccggcggcggagaccccggcggggagcgggtacgtggcacccggcgacctgacgtcggcggtgctccccgccgtgcagggcaacgccaagtacggcggcatcatggtgtggaaccggttctacgacgtgcagaacaacttcagcaaccaggtgaagagcagcgtc

SEQ ID NO: 628 - protein, 302 aa, Oryza sativa
MAANKLKFSPLLALFLLAGIAVTSRAGDIAVYWGQNGDEGSLADACNSGLYAYVMVAFLSTFGNGQTPVLNLAGHCEPSSGGCTGQSSDIQTCQSLGVKVILSIGGGAGSYGLSSTQDAQDVADYLWNNFLGGSSGSRPLGDAVLDGVDFDIETGNPAHYDELATFLSRYSAQGAAKKVILTAAPQCPYPDASLGPALQTGLFDSVWVQFLQPTRRASTPTATPSNLVSAWNTWTGGVSAGSFYVGVPAAETPAGSGYVAPGDLTSAVLPAVQGNAKYGGIMVWNRFYDVQNNFSNQVKSSV

SEQ ID NO: 629 - DNA, 714 bp, Oryza sativa
atggcagcctacgggaagccgcagccgccgctgaacgacgcgtactacggcccgccgatcccgccgccaccggcggcagcgtactacggcgcagcggcgcctccgcccgcgccacgccggagcggcgcgcaccgtctgttctgctgcctcttcagggtgctcgccgtcgccgtcatcgcgctcggcaccgccgtcctcgtcctctggctcatctaccgccccagcgtcgtcaaggcctacgccgacaccgctgcgctgtcccgcttcgacctcaccaacggcggcagcctcctcgtgtacaacctcaccgtgggcatgcgcgtgcgcaaccccaaccgcttcggcatcaacttcaggagcgtcgacgcgcaggcgtcctacgacggcgaccggttcgggtacgcgccgctgcagccgttatacgttggtcggaagagcgacgccaggttcgacgtgacgctgagcggctcggcggccatcgacgaccgcgacgtggagcgcacataccggagggagacggcgcaggggtcttacgaggttaaggtcagggtgtacgctagacaaggattcaaggtcaggggcttcaggctgaacaacaagagcaaattcacctgcacgctgaacctgccggcgcccaactccggcaacggcaccgcgagcgggacgccgacgacggtgttcacgaggaagcagccgaagtgcgacgtggactat

SEQ ID NO: 630 - protein, 238 aa, Oryza sativa
MAAYGKPQPPLNDAYYGPPIPPPPAAAYYGAAAPPPAPRRSGAHRLFCCLFRVLAVAVIALGTAVLVLWLIYRPSVVKAYADTAALSRFDLTNGGSLLVYNLTVGMRVRNPNRFGINFRSVDAQASYDGDRFGYAPLQPLYVGRKSDARFDVTLSGSAAIDDRDVERTYRRETAQGSYEVKVRVYARQGFKVRGFRLNNKSKFTCTLNLPAPNSGNGTASGTPTTVFTRKQPKCDVDY

SEQ ID NO: 631 - DNA, 492 bp, Oryza sativa
atgccggcgggccacgggctgcgtgcgcggacgcgcgacctgttcgcgcggccgttcaggaagaaggggtacatcccgctcaccacctacctccgcacctacaagatcggcgagcacgtcgacgtcaaggtgaacggcgccgtgcacaaggggatgccgcacaagttctaccacggccgcaccggccgcgtctggaacgtcaccaagcgcgccatcggcgtcgagatcaacaagcaggttgggaaccgcattatcaggaagaggatccatgtccgtgtggagcatgtgcagccatccaggtgcactgaggagttccgcctgaggaagatcaagaacgaccagctcaaggcagatgccaaggctcgtggtgaggtcatcagcacgaagaggcagccgcagggtcctaagcccggcttcatggttgagggtgcaacactggagactgtcacccccatcccgtacgatgtggtcaatgatctcaagggtggttac

SEQ ID NO: 632 - protein, 164 aa, Oryza sativa
MPAGHGLRARTRDLFARPFRKKGYIPLTTYLRTYKIGEHVDVKVNGAVHKGMPHKFYHGRTGRVWNVTKRAIGVEINKQVGNRIIRKRIHVRVEHVQPSRCTEEFRLRKIKNDQLKADAKARGEVISTKRQPQGPKPGFMVEGATLETVTPIPYDVVNDLKGGY

SEQ ID NO: 633 - DNA, 498 bp, Oryza sativa
atgccgccgaagctcgacccgacccaggtggtggatgtgttcgtccgcgtgaccggcggtgaggtcggcgcggcgtcgtcgctcgcccccaagatcgggccgctcggtctctccccgaagaagatcggagaggacatcgccaaggagaccgccaaggactggaagggcctccgcgtcaccgtgaagctcaccgtccagaaccggcaggccaaggtctccgtcgtcccctccgccgcggcgctcgtcatcaaggcgctcaaggagcccgagagggaccgcaagaaggtgaagaacatcaagcacagcggcaacatcagcctcgacgacgtcatcgagatcgcgagggtcatgaggcccaggtccatggccaaggagatggccggcaccgtcaaggagatcctcggcacctgcgtcagcgtcggctgcaccgtggacggcaaggaccccaaggacctgcagcaggagatctccgacggcgaggtcgagatcccctcagct

SEQ ID NO: 634 - protein, 166 aa, Oryza sativa
MPPKLDPTQVVDVFVRVTGGEVGAASSLAPKIGPLGLSPKKIGEDIAKETAKDWKGLRVTVKLTVQNRQAKVSVVPSAAALVIKALKEPERDRKKVKNIKHSGNISLDDVIEIARVMRPRSMAKEMAGTVKEILGTCVSVGCTVDGKDPKDLQQEISDGEVEIPSA

SEQ ID NO: 635 - DNA, 774 bp, Oryza sativa
atgttggccatattccagaagcaggtggcgcacgcgccggcggagctgaacagcccgcggagcagcgcggcgaagcccaagaaccccgacgagatcctcagggacttccacgccctccaccccatcgaggccttctccacctccttcggcggcggcgccgccctcgcctgcgtcgccggccacgcccgcaatggcctctctggctacgagaggatgttctgtgggctggatgacatctactgcgtgttcatggggaggctggacaacctgagcagcctgatccggcagtacgggctgtgcagccgctccaccaacgaggcgctgctcgtcatcgaggcctaccgcaccctccgcgaccgcggcccctaccccgccgaccaggtcgtcaaggatctctccggctccttcgccttcgtcgtcttcgacaacaagtccggcgccgtcttcgccgccctgagtacggatggggaggtgccgttgtattgggggatcgcggcggatgggtcggtggtgatctgcgacgagagggagatcgtgaagggagggtgcggcaagtcgtacgcgccgttcccggtggggtgcatgttccacagcgagggggggctcaagagcttcgagcacccgatgaaccggctgaaggcgatgccgcgggtggacagcgagggcgtcatgtgcggcgccaccttcaaggtcgacaccttcaccaagatcaactccatgccccgcgtcggcagcgccaccaactgggccgccacctgggacgacgctgccgcc

SEQ ID NO: 636 - protein, 258 aa, Oryza sativa
MLAIFQKQVAHAPAELNSPRSSAAKPKNPDEILRDFHALHPIEAFSTSFGGGAALACVAGHARNGLSGYERMFCGLDDIYCVFMGRLDNLSSLIRQYGLCSRSTNEALLVIEAYRTLRDRGPYPADQVVKDLSGSFAFVVFDNKSGAVFAALSTDGEVPLYWGIAADGSVVICDEREIVKGGCGKSYAPFPVGCMFHSEGGLKSFEHPMNRLKAMPRVDSEGVMCGATFKVDTFTKINSMPRVGSATNWAATWDDAAA

SEQ ID NO: 637 - DNA, 912 bp, Oryza sativa
atgggagggtttgtcaagacccagaagaccaatgcctaccacaagcgtttccaagtcaagttcaagagacggaggcagggcaagactgactacagggccaggattaggctcaccaaccaagataagaacaagtacaacacaccgaagtaccgcttcgttgtgagatttacaaacaaagatatcacagctcaaattgtctatgctaccattgctggtgatatcgtgatggctgctgcctactcccatgagctgcctcgctatggtcttgaagttggtctcaccaactatgcggcagcttattgcactggcttgcttttggctcgccgtgtgctcaagctccgtggtttggaccaggagtacgagggcaatattgaggccactggggaggactactatgttgaaccagctgatgaaaggcggcctttccgtgctctcttggatgttggcctcattaggacaaccactggaaaccgtgtctttggtgccctcaagggagctttggatggtggtcttgacattcctcacagtgacaagaggtttgctgggttcaagaaggacgagaagcagcttgattctgatattcaccgcaagtacatctacggtgggcacgtggctgactacatgaggtctatggcggaggaggaacctgagaaattccaagcccacttcagtgagtacctcaagaagggaattgatgctgatggcatggaagcactgtacaagaaggtccatgctgccatccgtgctgatcctaccatggccaaatcaaccaagaaggaaccggcgacccacaagagatacaacctcaagaagctaacctacgaacagaggaaggccagtcttgtcgaaagattgaatgctctcaactcctctgctggtgctgatgatgatgacgaggaagaggatgatgag

SEQ ID NO: 638 - protein, 304 aa, Oryza sativa
MGGFVKTQKTNAYHKRFQVKFKRRRQGKTDYRARIRLTNQDKNKYNTPKYRFVVRFTNKDITAQIVYATIAGDIVMAAAYSHELPRYGLEVGLTNYAAAYCTGLLLARRVLKLRGLDQEYEGNIEATGEDYYVEPADERRPFRALLDVGLIRTTTGNRVFGALKGALDGGLDIPHSDKRFAGFKKDEKQLDSDIHRKYIYGGHVADYMRSMAEEEPEKFQAHFSEYLKKGIDADGMEALYKKVHAAIRADPTMAKSTKKEPATHKRYNLKKLTYEQRKASLVERLNALNSSAGADDDDEEEDDE

SEQ ID NO: 639 - DNA, 2424 bp, Oryza sativa
atggcgagccagggggagccctcgtcgtcggccgatccgaaggggaagaaggactactcgacggcgatcctggagaggaagaagtcgccgaaccggctggtggtggacgaggccaccaatgacgacaactccgtcgtcgcgctgcacccggacaccatggagaggctgcagctcttccgcggcgacaccgtcctcctcaagggcaagaagaggaaagatactatttgcattgtccttgcggacgaaacctgtgaggagcccaagattaggatgaacaaggttgtcaggaagaacctgagggtgcgacttggtgatgttgtttctgtccaccagtgccaggatgtgaaatacgggaaacgtgtgcacattcttccgattgatgatacagttgaaggcattaccgggaacctgtttgatgccttcctgaagccatacttcttagaagcataccgcccagtgaggaaaggagatctcttccttgtcaggggtggaatgagaagtgtggaattcaaagtcatagagactgaccctactgagtattgcatcgttgcaccagatacagaaatattctgtgatggggagcctattaagagggaagatgaggaaaggcttgatgaggttggatatgatgatgttggtggagttagaaagcagatggctcaaatcagagagcttgttgagcttccactgcgtcatccccaacttttcaaatccattggtgtgaagccaccaaagggcatattgctgtatggaccacctggttctggaaaaaccctcattgctcgtgctgttgcaaatgagactggagcctttttctttttgattaatggacctgagattatgtcaaagctagctggagagagtgagagcaatctcaggaaggcatttgaagaagcagagaagaatgcaccatctatcattttcattgatgagattgattccattgctcccaagagagagaagaccaatggagaagtggaacgtcgtattgtttcacagctgttgactcttatggatggactcaaagctcgttctcatgttattgttatgggtgctacaaaccgtcccaacagcattgatcctgctcttcggaggtttggaaggtttgaccgtgagattgacattggtgtccctgatgaggttgggcggcttgaggttcttcgtattcacactaagaacatgaagctagctgaagatgttgatttggaactcattgcgaaggatactcatggatatgttggtgctgatcttgctgccctttgcactgaggctgctcttcagtgcattcgtgagaagatggatatcatagatcttgaggacgagacaatagatgctgagatattgaactcgatggctgtcacaaatgaccatttcaaaaccgcgcttggtacaagcaacccatctgctcttcgtgaaactgttgttgaagttcctaatgtctcatgggaggacattggtgggctggagaatgtcaagagggagctgcaggagactgtccaatatccagtggagcacccagagaagttcgagaagtttggaatgtctccatccaaaggagttctgttctatggccctcctggctgtggtaagaccttgttggccaaggcaattgccaatgagtgccaggcaaacttcatcagtgtgaagggcccagagttgctcaccatgtggtttggagagagtgaagctaatgttcgtgagatatttgacaaggcccgccagtctgcgccatgtgtgctcttcttcgacgagcttgactcaattgctactcagagaggaagcagtgtgggtgatgctggaggtgcagctgatagggtgctgaatcagctgttgacagagatggatggcatgaatgccaagaagactgttttcattattggggctacaaacaggcctgacatcatagatccggccttgcttaggccagggcgtctcgatcagctgatctacattccactgcctgatgagcaatctaggctccaaattttcaaagcttgcctcaggaagtcccctgtggcgaaggatgtggacttgaacgctcttgccaagtacacccaaggcttcagtggtgcagatattacagaaatctgtcagcgtgcatgcaaatatgcgattagagagaacatcgagaaggacattgagagggagaggcggagtaaggagaaccctgaagcgatggaggaagatgaagtcgacgacattgctgagatcaaggcagcccacttcgaggagtcgatgaagtacgcgcgccgcagtgtcagcgatgccgacatccgcaagtaccaggcgttcgcccagacgttgcagcagtctcgcgggtttggcagtgagttccgtttcgagcggacagaagctggtgctggagctgcggctgatccttttgcgtctgctgccgccgtcgctgatgatgacgatttatatagt

SEQ ID NO: 640 - protein, 808 aa, Oryza sativa
MASQGEPSSSADPKGKKDYSTAILERKKSPNRLVVDEATNDDNSVVALHPDTMERLQLFRGDTVLLKGKKRKDTICIVLADETCEEPKIRMNKVVRKNLRVRLGDVVSVHQCQDVKYGKRVHILPIDDTVEGITGNLFDAFLKPYFLEAYRPVRKGDLFLVRGGMRSVEFKVIETDPTEYCIVAPDTEIFCDGEPIKREDEERLDEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDEIDSIAPKREKTNGEVERRIVSQLLTLMDGLKARSHVIVMGATNRPNSIDPALRRFGRFDREIDIGVPDEVGRLEVLRIHTKNMKLAEDVDLELIAKDTHGYVGADLAALCTEAALQCIREKMDIIDLEDETIDAEILNSMAVTNDHFKTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEQSRLQIFKACLRKSPVAKDVDLNALAKYTQGFSGADITEICQRACKYAIRENIEKDIERERRSKENPEAMEEDEVDDIAEIKAAHFEESMKYARRSVSDADIRKYQAFAQTLQQSRGFGSEFRFERTEAGAGAAADPFASAAAVADDDDLYS

SEQ ID NO: 641 - DNA, 753 bp, Oryza sativa
atgagcaacaccaccatggctatttccaccatccttctcttcctcctcgccggcctcgtcgccgcccacggcgacggcgacaccatgatccgtctcccaagcgacggcgccgaagcaccaccacgcccgcccaaaccctgggactgctgcgacaacatcgagatgtccccgctcgagatcttcccgccgctgtaccgctgcaacgacgaggtgaagcagtgctccgccgcctgcaaggagtgcgtggaggcgcccggcgacttcccccgcggcgccttcgtgtgccgcgactggtactcgacggtggacccgggccacatgtgcacggcgccggatcagccgacgacgaagaggccgtggaagtgctgtgacagcatcgtgcagctgccgcagaggatcttcccgccgttctggcgctgcgacgacgagctggagcccggcaagtgcaccgccgcgtgcaagtcgtgcagggaggcgccggggccgttcccggggccgctcatctgcgaggacgtctactggggcgccgacccgggccccttgtgcacgccgcggccatgggggaaatgctgcgacaaggccttctgcaacaagatgaacccgccgacctgccgctgcatggacgaggtgaacaagtgcgccgccgcgtgcaaggattgccagcgtgtggagtcgtcagagccgcctcgctacgtctgcaaggaccgcttcaccggccagcccgggcccatgtgcaaaccccgagcggagaac

SEQ ID NO: 642 - protein, 251 aa, Oryza sativa
MSNTTMAISTILLFLLAGLVAAHGDGDTMIRLPSDGAEAPPRPPKPWDCCDNIEMSPLEIFPPLYRCNDEVKQCSAACKECVEAPGDFPRGAFVCRDWYSTVDPGHMCTAPDQPTTKRPWKCCDSIVQLPQRIFPPFWRCDDELEPGKCTAACKSCREAPGPFPGPLICEDVYWGADPGPLCTPRPWGKCCDKAFCNKMNPPTCRCMDEVNKCAAACKDCQRVESSEPPRYVCKDRFTGQPGPMCKPRAEN

SEQ ID NO: 643 - DNA, 594 bp, Oryza sativa
atggcttcgtcgctggccctggtagctctgctcctcgtgagctgcgccgtggtggcggcggcggcgaccaagtacaccgtcggcgacacgtccggctgggcgatgggggcggattacaccacctgggccagcgacaagaaattcaaaatgggcgataccctcgtgttcaactacgccggtggggcgcactcggtggatgaggtgagcgcagcggactacgctgcgtgcaccgctagcaacgcgctccagagcgacagcagcggcacgaccaccgtcaccctcaagaccgccggcaagcactacttcatctgcggcatcgccggccactgcagcaacggcatgaagctcgtcgtggacgttgccgcggcctctccagccccagccccaaaagccccgtccaccacaccgacgactccatctacgacaccagcgacaccggcgtcccctggcacaagctccggtctgacgcccacaaccccagcaacggtgctcgcgccgcccgccaagcagtccgccggtgcagctgggctcagggccaggtcatgggctatgctgggcctggcaggacttgccgccgtgcaactgggcctcttc

SEQ ID NO: 644 - protein, 198 aa, Oryza sativa
MASSLALVALLLVSCAVVAAAATKYTVGDTSGWAMGADYTTWASDKKFKMGDTLVFNYAGGAHSVDEVSAADYAACTASNALQSDSSGTTTVTLKTAGKHYFICGIAGHCSNGMKLVVDVAAASPAPAPKAPSTTPTTPSTTPATPASPGTSSGLTPTTPATVLAPPAKQSAGAAGLRARSWAMLGLAGLAAVQLGLF

SEQ ID NO: 645 - DNA, 927 bp, Oryza sativa
atggttgttccggtgatcgacttctccaagctcgacggcaccgccgcagagagggctgagacgatggcgcagatcgacaatggctgcgaggagtggggattcttccagctggtgaaccatggcgtcccgaaggagcttcttgatcgggtgaagaaggtgtgcttggagagctaccgactccgggaggcggcgttcatggagtcggagccggtgaggacgctggaggggctcatggcggcggagcggcgcggcgaggcggcggcgccggtggacgacatggactgggaggacatcttctacctccacgacgacaaccagtggccgtcgaacccgccggagttcaaggagacgatgcgcgagtaccgcgcggcgctgcgggggctcgccgagagggtgatggaggccatggacgagaacctcggcctcgacaaggggcgcatgaggcgcgccttcaccggcgacggccgccacgcgccgttcttcggcaccaaggtcagccactacccgccgtgcccgcgcccccgacctcatcaccggcgtccgggcccacaccggacgccggggggcgtcatcctgctgttccaggacgaccgcgtcggcggcctccaggtgctcaggggcggcgagtgggtcgacgtgcagccgctcgccgacgccatcgtcgtcaacaccggcgaccaggtggaggtgctcagcaacggccgctaccgcagcgcgtggcaccgcgtcctccccatgcgcgacggaaaccggcgctccgtcgcgtcgttttacaacccggcgttcgaggccaccatctcgccggcggtgggcgccggcggcgagtacccggagtacgtgttcggcgagtacatggatgtgtacgccaagcagaagttcgatgcgaaggagccacgcttcgaggccgtcaaggcgccaaaatctgct

SEQ ID NO: 646 - protein, 309 aa, Oryza sativa
MVVPVIDFSKLDGTAAERAETMAQIDNGCEEWGFFQLVNHGVPKELLDRVKKVCLESYRLREAAFMESEPVRTLEGLMAAERRGEAAAPVDDMDWEDIFYLHDDNQWPSNPPEFKETMREYRAALRGLAERVMEAMDENLGLDKGRMRRAFTGDGRHAPFFGTKVSHYPPCPRPRPHHRRPGPHRTPGGVILLFQDDRVGGLQVLRGGEWVDVQPLADAIVVNTGDQVEVLSNGRYRSAWHRVLPMRDGNRRSVASFYNPAFEATISPAVGAGGEYPEYVFGEYMDVYAKQKFDAKEPRFEAVKAPKSA

SEQ ID NO: 647 - DNA, 1023 bp, Oryza sativa
atggcgtccgagggcgtgctcctggggatgggcaaccccctcctcgacatctccgccgtcgtcgacgacgccttcctcaccaagtatgacgtcaagctgaacaatgcaattctcgctgaggaaaagcacttgcctatgtatgatgagttggccagcaagggcaatgttgaatatattgccggaggagccacccagaactctatcagggttgctcaatggatgcttcaaactcctggtgcaacaagttacatgggttgcattggaaaggataagtttggtgaggagatgaagaagaatgcccaagctgctggtgttactgctcattactacgaggatgaggctgctcccacgggcacatgtgctgtctgtgttgttggtggtgaaagatcactggttgcaaacttatcagcagcaaactgctacaaatctgagcatctgaagaaaccggagaactgggcactagtggagaaagcaaaatacatctacattgctggctttttccttacggtctccccagattctattcagcttgttgctgagcatgctgccgctaacaacaaggtgttcctgatgaacctctctgcaccctttatctgtgagtttttccgtgatgcccaggagaaggttcttccgtttgtggactacatcttcggtaacgaaacagaagcaagaatctttgctaaagtccgtggatgggagactgagaatgttgaggagatcgcgttgaagatttcccagcttccattggcctctggaaaacaaaagaggattgccgtgattactcaaggtgctgatccagtagttgtcgctgaggatggacaggtgaaaacattccctgtgatcctactgccaaaggagaagcttgttgacaccaatggcgctggtgatgcctttgttggaggcttcctctcacaattggttcaacaaaagagcattgaggactctgtgaaggctggttgctatgccgcaaatgttatcatccagcgttctggctgcacttaccctgagaagcctgatttcaac

SEQ ID NO: 648 - protein, 341 aa, Oryza sativa
MASEGVLLGMGNPLLDISAVVDDAFLTKYDVKLNNAILAEEKHLPMYDELASKGNVEYIAGGATQNSIRVAQWMLQTPGATSYMGCIGKDKFGEEMKKNAQAAGVTAHYYEDEAAPTGTCAVCVVGGERSLVANLSAANCYKSEHLKKPENWALVEKAKYIYIAGFFLTVSPDSIQLVAEHAAANNKVFLMNLSAPFICEFFRDAQEKVLPFVDYIFGNETEARIFAKVRGWETENVEEIALKISQLPLASGKQKRIAVITQGADPVVVAEDGQVKTFPVILLPKEKLVDTNGAGDAFVGGFLSQLVQQKSIEDSVKAGCYAANVIIQRSGCTYPEKPDFN

SEQ ID NO: 649 - DNA, 1017 bp, Oryza sativa
atggctctcgtccgccagcgacgccacctgccgcacctcaccctcccgctcgatcacttcgccctccgcccgccgccggcgccgcagcagcagcagcagcccgcagtcgcgccgtccacctcctctgacgtccgcctctcggacttcgagaggatctccgtcctcggccacggcaacggcgggacggtgtacaaggcgcgccaccgacggggttgccccgcgcagcagccgctcgcgctcaagctcttcgccgccggggacctctccgcggcgcgggaggccgagatactcaggctcgcggcggatgccccgcacgtcgtgaggctccacgcggtggtcccgtcggccgccggtggggtggaggagcccgccgcgctggcgctcgagctcatgcccgggggttccctggctgggttgcttcgccgtctcgggcgcccgatgggggagcgccccatcgccgccgtggcgaggcaggcgctactcgggctcgaggcccttcacgcgctccgcatcgtgcaccgcgacctcaagccgtcgaacctgctcctcggcgccgacggcgaggtcaagatcgccgacttcggcgcgggcaaggtcctgcggcggcggctcgacccctgcgcgtcctacgtcgggacggcggcctacatgtccccggagaggttcgacccggaggcctactccggcgactacgacccgtacgccgccgacgtgtggagcctcggggtagcgatccttgagctgtacctcggccacttcccgcttctccccgtggggcagcgccccgactgggcggcgctcatgtgcgccatatgcttcggcgaggcgccggagatgccggccgccgcgtcggaggagttccgggacttcgtgtcgcggtgcctcgagaagaaggccgggcggcgcgcgtcggtcggcgagctgctcgagcacccgttcatcgccgagcgggacgccgccgatgcgcagcgctcgctcgccgcgctcgtcgccgaggcggagcagagcggcgatcta

SEQ ID NO: 650 - protein, 339 aa, Oryza sativa; identical to SEQ ID NO: 428

SEQ ID NO: 651 - DNA, 822 bp, Oryza sativa
atggccgggatcgtggtggtgttcgacttcgacaagacgatcatcgacgtcgacagcgacaactgggtcgtggacgggctcggcgcgacggaggagttcgagcggctgctgcccaccatgccgtggaacaccctcatggacaccatgatgggcgagctccacgcgagcggcaagtcgctcgccgacgtcgcgggcgtgctcaggtcggcgccgctcgacccgcgcgtcgtcgccgccatcaaggcctgctacggcctgggctgcgacctccggatcctcagcgacgccaaccgcttcttcatcgacaccatcctcgaccaccacggcctcacgggttacttctccgagatcaacaccaacccgagcgccgtcgacgccgccaccggccgcctccgcatcgcgccgtaccacgacttccacgccggcccgcacgggtgcggcctcgggatctgcccgcccaacatgtgcaagggccaggtgctcgaccgcatccgcgcctccgccggcgccgccggcaagagggtcatctacctcggtgacggccgcggcgactactgcccgtcgctccgcctcggccgcgacgacttcatgatgccacgcaggggcttccccgtgtgggagctcatctgcgaggacccgtcgctgctccacgcggaggtgcactcgtgggccgacggcgccgagatggaggagacgctgctgcggctggtcggcagggtgctcctcgaggagaggaacctgccgccgctcgactgcaagctcgagtcgttgccggccgtcgccgtgcaggacggcatgcccatgacgctccggatcaagaac

SEQ ID NO: 652 - protein, 274 aa, Oryza sativa
MAGIVVVFDFDKTIIDVDSDNWVVDGLGATEEFERLLPTMPWNTLMDTMMGELHASGKSLADVAGVLRSAPLDPRVVAAIKACYGLGCDLRILSDANRFFIDTILDHHGLTGYFSEINTNPSAVDAATGRLRIAPYHDFHAGPHGCGLGICPPNMCKGQVLDRIRASAGAAGKRVIYLGDGRGDYCPSLRLGRDDFMMPRRGFPVWELICEDPSLLHAEVHSWADGAEMEETLLRLVGRVLLEERNLPPLDCKLESLPAVAVQDGMPMTLRIKN

SEQ ID NO: 653 - DNA, 480 bp, Oryza sativa
atgagcgccacggcggtgtcgtcgctgaacccggacgcgccgctcttcatcccggcggcgttccggcaggtggaggacttctcgccgcagtggtgggacctcgtcaagaccaccgcctggttccgcgaccactggttccacgagcaccagcagctcgacgagatggccgactccctcgccctccacgacgccgccgccgacgacgacgacctcgccggcctcctccccgacgacgccttcgacgacgacgacgacgacgacctcttcttcgaccagacccataacctcctcgtcgatcccccgcagccgcccgccgctctcaagactgatgcggtgctcaaggcgctgagcctggtgtctcccaagggcggcgacgcgccgcgggggctccgggagaagccccggcactccgagaagcccaccaagtacgccggcagcccgaggagcggcggcgctccccgcgtcatccaccagcctcgc

SEQ ID NO: 654 - protein, 160 aa, Oryza sativa; identical to SEQ ID NO: 54

SEQ ID NO: 655 - DNA, 555 bp, Oryza sativa
atgaagaccgccatgactacttccacccttctcttcctcctcctcgccggcctcaccgccgccgccctcggcacggcggacgacgacaccaccaccaacaccatacgcctcccgaccgacggaggatcagcacagcaggcgccgacgaagaagaagccgtggaagtgctgcgacaacatcgagcggctgccgacgaagaccaacccgccgcagtggcgctgcaacgacgagctggagcccagcaagtgcgtggcacagtgcgaggtgtgccaggaggcgccggggccattcccgggcccgctcatctgcagcgacgtctactggggcgccgacccgggtcccttctgcacgccgcggccgtggggagattgctgcaccaacaccacctgcaccaggtcgatcccgccgatctgccgctgcaacgacaaggtgaagaagtgcgccgccgcgtgcaaggattgcaagcgggtgaagtcgtcgaagcctcctcgctacgtctgccaggaccagttcaccggccagccagggcccaagtgcaaacactcgtgcgagaac

SEQ ID NO: 656 - protein, 185 aa, Oryza sativa; identical to SEQ ID NO: 22

SEQ ID NO: 657 - DNA, 807 bp, Oryza sativa
atgtcgagcgcgtcgtccatggaagcgctccacgccgcggtgctcaaggaggagcagcagcagcacgaggtggaggaggcgacggtcgtgacgagcagcagcgccacgagcggggaggagggcggacacctgccgcaggggtgggcgaagcggaagcggtcgcgccgccagcgatcggaggaggagaacctcgcgctctgcctcctcatgctcgcccgcggcggccaccaccgcgtccaggcgccgcctccgctctcggcttcggcgcccccgccggcaggtgcggagttcaagtgctccgtctgcggcaagtccttcagctcctaccaggcgctcggcggccacaagacgagccaccgggtcaagctgccgactccgcccgcagctcccgtcttggctcccgcccccgtcgccgccttgctgccttccgccgaggaccgcgagccagccacgtcatccaccgccgcgtcctccgacggcatgaccaacagagtccacaggtgttccatctgccagaaggagttccccaccgggcaggcgctcggcgggcacaagaggaagcactacgacggtggcgtaggcgccggcgccggcgcatcttcaaccgagctcctggccacggtggccgccgagtccgaggtgggaagctccggcaacggccagtccgccacccgggcgttcgacctcaacctcccggccgtgccggagttcgtgtggcggccgtgctccaagggcaagaagatgtgggacgaggaggaggaggtccagagccccctcgccttcaagaagccccggcttctcaccgcg

SEQ ID NO: 658 - protein, 269 aa, Oryza sativa
MSSASSMEALHAAVLKEEQQQHEVEEATVVTSSSATSGEEGGHLPQGWAKRKRSRRQRSEEENLALCLLMLARGGHHRVQAPPPLSASAPPPAGAEFKCSVCGKSFSSYQALGGHKTSHRVKLPTPPAAPVLAPAPVAALLPSAEDREPATSSTAASSDGMTNRVHRCSICQKEFPTGQALGGHKRKHYDGGVGAGAGASSTELLATVAAESEVGSSGNGQSATRAFDLNLPAVPEFVWRPCSKGKKMWDEEEEVQSPLAFKKPRLLTA

SEQ ID NO: 659 - DNA, 795 bp, Oryza sativa
atggcaaggggtttgaagaagcatctgaagaggctcaatgcgcccaagcattggatgctcgacaagcttggtggagcttttgcccccaagccatcttctggtcctcacaagtccagggagtgcctgcctctgatcctcattatcaggaacaggctcaagtatgctctgacataccgtgaggttatttctatcctcatgcagcgccatgtcttggttgatggcaaggtcaggactgacaagacctacccagctggtttcatggatgtcatttccatccccaagactggtgagaactacaggcttctgtacgacaccaagggacgtttccgccttcagtctgtcaaggatgaggatgctaagttcaagctttgcaaggttcggtctgtgcagtttggccagaagggaatcccctacctgaacacctatgatggtcgcaccatccgctaccctgacccgatcatcaaggcaaacgacacaatcaagatcgatctggagaccaacaagattgtcgacttcatcaagtttgatgttggcaatgttgtcatggtgactggaggaaggaacacaggccgtgttggtgtgatcaagaacagggagaagcataaaggcagcttcgagaccatccacgttgaggatgccctgggccaccaattcgccacccgtctgggcaatgtgttcaccattggcaagggcaacaagccttgggtgagcctgcccaagggcaagggcatcaagctcagcatcatcgaggagcaaaggaagcgggatgctgccgcccaggctgctgccaacgct

SEQ ID NO: 660 - protein, 265 aa, Oryza sativa
MARGLKKHLKRLNAPKHWMLDKLGGAFAPKPSSGPHKSRECLPLILIIRNRLKYALTYREVISILMQRHVLVDGKVRTDKTYPAGFMDVISIPKTGENYRLLYDTKGRFRLQSVKDEDAKFKLCKVRSVQFGQKGIPYLNTYDGRTIRYPDPIIKANDTIKIDLETNKIVDFIKFDVGNVVMVTGGRNTGRVGVIKNREKHKGSFETIHVEDALGHQFATRLGNVFTIGKGNKPWVSLPKGKGIKLSIIEEQRKRDAAAQAAANA

SEQ ID NO: 661 - DNA, 558 bp, Oryza sativa
atgaccatgaaagtgaagagcaccatgatggctgcttccatgctgctcttcctcctcgtcctcgccggcatcgtcaccgccaccaccaccaccaccgacagcaacattcgcctccccagcaacggcgccgccggcgaaaccgatggaaacaaacaggcgaaatccagaccgtgggagtgctgcgacaacatcgagatgtccgtgctcaagatctacccgccgcggtggcgttgcaacgacgaggtgaagcagtgcgccgccgcctgcgagaactgcctgcagctggtgcccggggccggcggcgaagatgtcgtcttcgtctgcgacgactggtacccgaccaccaaccctggccccgtctgcacgccgcggccgtggggcgattgctgcgacaaggccttctgcaccaggtctctcccaccgatctgccactgcgccgacgaggtggcgtcgtgcgccgccgcctgcaaggagtgcgacatggtgaattcgtcgtcggagccgcctcgctatatctgccgcgaccacttcaccggcgagcccgggcccatgtgcgca

SEQ ID NO: 662 - protein, 186 aa, Oryza sativa
MTMKVKSTMMAASMLLFLLVLAGIVTATTTTTDSNIRLPSNGAAGETDGNKQAKSRPWECCDNIEMSVLKIYPPRWRCNDEVKQCAAACENCLQLVPGAGGEDVVFVCDDWYPTTNPGPVCTPRPWGDCCDKAFCTRSLPPICHCADEVASCAAACKECDMVNSSSEPPRYICRDHFTGEPGPMCA

SEQ ID NO: 663 - DNA, 1584 bp, Oryza sativa
atggcggacgccgacgcgagggccccgcccaaatcggaccccggcgccacgccgatcggttcgatctccccttcctccgccgcccccgccgccggggaggacgaggtggaggtcgaggtggaggtggaggagcagctcgccggactcgccatcgccgatcagggggaggagctgctgcttcccaagcccaccggctgggaggatggccctgttgttgttgctggagatgaggtctccggtggtgagaagctgccgggtgaggtggcggcggcggtgggggtggagggtgctgcggcggattcgaggccgcggttcccgaggcgacccggggagccggactgcacctactacgtcaagttcgggagctgccgctttgggatgaagtgcaagttcaatcatccggcgaggaagaagaagagtagggtgaaaggtagtaacggtggtagtggcagcggcgggagcaacagcagcagtaacaaagcctcctcgcctgatgatgagcaggctccaaaagaggaatacggaagctatgttccagatatttcacctgaagttgattctttgggatttgctgacaaggggagtgcgtctaacttagaaaactttaagaaatattcttatgagattatcgatgtgaagaagggaagagtggagccaaaggaacttaaggttgccaaagagaaaaggaaggaatttatttcagaaggtagttcccaggaggaatgcaagtattattcaacacctggaggatgcaaatttggtaaagcttgtaaatacctccaccgtgatggaaaagaagggaaaacagacgctgaaaaggttgacctgaactttctcggtcttccacttcgtccaggggaaaaggagtgtccctactacatgcgtactgggagctgcaagtacgccactaactgcaagtttcaccatcctgatccttctaatgttgcttctaaagatccacagttggagcatgagaatggggatgctccacagcaagatgttcaaggatcatcgtctcagccaaatgcttcaatttggcccgatcagagaacagtgaatgagcatcatgttccgtttatagctccatctccatcgtacagtgcagggatgcttcctcctcaaggaatgtatccacctcctgaatggaatgggtatcatcaggttccgttgaatccatattatcctcctggagtccctttccaacattttccagctgctcctataaatcatcctatgtacaaggcaccagaaatacctggacatcagcaggttccttccgaggaatacccagagagatctggccaacctgaatgtcagcattttgtgaagagtggtttttgcaaatttaggatgaagtgcaaatatcaccacccaaggtcaccggtgcctccagcaggagctcttagccctcttggcttgcctataaaacctgatcagcctgtgtgcacatactatggtcgctatggggtctgcaaatttgggccagcttgcgcatacaatcaccccttcaattttagccctgtacctgcagcgggacctcctctcctccctgctcaatacccaactccaggaaactacactctc

SEQ ID NO: 664 - protein, 528 aa, Oryza sativa
MADADARAPPKSDPGATPIGSISPSSAAPAAGEDEVEVEVEVEEQLAGLAIADQGEELLLPKPTGWEDGPVVVAGDEVSGGEKLPGEVAAAVGVEGAAADSRPRFPRRPGEPDCTYYVKFGSCRFGMKCKFNHPARKKKSRVKGSNGGSGSGGSNSSSNKASSPDDEQAPKEEYGSYVPDISPEVDSLGFADKGSASNLENFKKYSYEIIDVKKGRVEPKELKVAKEKRKEFISEGSSQEECKYYSTPGGCKFGKACKYLHRDGKEGKTDAEKVDLNFLGLPLRPGEKECPYYMRTGSCKYATNCKFHHPDPSNVASKDPQLEHENGDAPQQDVQGSSSQPNASIWPDQRTVNEHHVPFIAPSPSYSAGMLPPQGMYPPPEWNGYHQVPLNPYYPPGVPFQHFPAAPINHPMYKAPEIPGHQQVPSEEYPERSGQPECQHFVKSGFCKFRMKCKYHHPRSPVPPAGALSPLGLPIKPDQPVCTYYGRYGVCKFGPACAYNHPFNFSPVPAAGPPLLPAQYPTPGNYTL

SEQ ID NO: 665 - DNA, 333 bp, Oryza sativa
atgaagggacggcaaggccagcgcgtgaggctgtacgtccgcggcaccatcctcggctacaagaggtcgaagtcgaaccagtacgagaacacgtcgctgctgcagatcgagggggtgaacaccaaggaggaggttgggtggtacgccgggaagcgcatcgcctacgtctacaaggccaagacgaagagcaacgactccaccatccgctgcatctggggcaaggtcacccgcccgcacggcaactccggcgtcgtccgcgccaagttccggtccaacctcccgcccacctccatgggcaagaaggtccgcgtcttcatgtaccctagcagcatc

SEQ ID NO: 666 - protein, 111 aa, Oryza sativa
MKGRQGQRVRLYVRGTILGYKRSKSNQYENTSLLQIEGVNTKEEVGWYAGKRIAYVYKAKTKSNDSTIRCIWGKVTRPHGNSGVVRAKFRSNLPPTSMGKKVRVFMYPSSI

SEQ ID NO: 667 - DNA, 585 bp, Oryza sativa
atgtcgaaccacgcgtccggcatcctggtccacaagaccgacgaggacaaggtgatggtgctcgacagccacaagctgatgggcgcgtccggagagcccggcgaccgggtgcagttcaccgagttcatccagaagaatctccacctgtatcagttccgcaacaacatcccgctcagcaccgccgccaccgccaatttcacccgcggcgagctcgccaccgccctgcggaagaatccgtactatgtcaacgtgttgcttgctggatatgattcggatgttggtgcctctttgtattacattgactacatcgcaacattccataagatcgaaaagggtgcctttgggtatggctcctacttctgtctctcgctgatggacaagttatatcgtccagacatgtcagtcgaggaagctgttgatcttgttgacaagtgcattaaagaaattcggctcaggttggtcgttgctcctcaaaacttcataatcaagattgttgataaagagggtgctagggagtatgccaggcgtgcatacaccgacagtccaccggaagctgcaacatcagaagctgcaactgtagcagcc

SEQ ID NO: 668 - protein, 195 aa, Oryza sativa
MSNHASGILVHKTDEDKVMVLDSHKLMGASGEPGDRVQFTEFIQKNLHLYQFRNNIPLSTAATANFTRGELATALRKNPYYVNVLLAGYDSDVGASLYYIDYIATFHKIEKGAFGYGSYFCLSLMDKLYRPDMSVEEAVDLVDKCIKEIRLRLVVAPQNFIIKIVDKEGAREYARRAYTDSPPEAATSEAATVAA

SEQ ID NO: 669 - DNA, 627 bp, Oryza sativa
atggccggtagtagcgagcagcagctggtcgccaacgcggcggcgacgacggtggccgggaacgggagcaggttcgcggtgacgtgtggcttgctcaggcagtacatgaaggagcacagtggaagcaacggcggcggtggcttcttgccggcggtgacggccatgagcctcatgaccggcggcgctgatgcggaggaggaggcgccggaggtgaggaagaccatggagctcttccctcagcaggctgggacgctgaaagacacgcaagaaaggaaggagatcaccgagaaggcgcagctgaccatcttctacggcgggagcgtggtggtgttcgacgatttccccgccgagaaggccggcgagctgatgaaactcgccggctcccgcgacagcacggcggcggcggccgtctcagacgccggcgccgcagcggggcagccttgcctaccagacatgcccatcgcgaggaaggtgtcgctgcagaggttcctggagaagaggaagaacaggatcgtcgtggcggagccactgccggagtcggagaagaaggaggcggagtcgagcaagcgtgccaagaaagacgatggcggcgcgtcgtggctccaggtgaaccccactctcagcctg

SEQ ID NO: 670 - protein, 209 aa, Oryza sativa; identical to SEQ ID NO: 94

SEQ ID NO: 671 - DNA, 783 bp, Oryza sativa
atggccaccgtggggcagcctgatgccatgagaaggatcaccgttcactacgtgaatccgccgccgatcgccggcgccggagaagcacacgtcgatggcctcgacgacgaggttcttgattatgtgattggtgatgttcttcaggatcaggagggtctgtatcaatcgatattgtatggcaaatacggggatgacatgagaggggcaagaaacactgctcttgcccaatctgatggtttacattactactatcacggagagaacagcagtggtgaagcaacaacctcgagaaattcagaaatcgaccaacagattgagtatgacttggtgttcgctaggcagctgcaggcaatggataatctgacaattgagacacctgcagatgaagatgatgatataagctgcgtaccctctccatctgactctgaaaccgatgaaccggcagaaggcaacaacgaagaggctgccacacaggatgataacgatgatccagacaacatgacatacgagcaaaggcaggcacttgtggaatctgtaggaaatgagaacagaggtttatctgatctgcttatctcctacttggagacatggaagtacaaatcaggctttttcccaaggaaggcaaaccatgataactgtcctatatgtctatccgctttcagacgccgagaaacactcattacattggcttgcaagcatagttaccatgaaggttgtattgctagatggctcaagattgacaaggcctgcccagtttgcaaatatgaagtgtttggaccttcc

SEQ ID NO: 672 - protein, 261 aa, Oryza sativa
MATVGQPDAMRRITVHYVNPPPIAGAGEAHVDGLDDEVLDYVIGDVLQDQEGLYQSILYGKYGDDMRGARNTALAQSDGLHYYYHGENSSGEATTSRNSEIDQQIEYDLVFARQLQAMDNLTIETPADEDDDISCVPSPSDSETDEPAEGNNEEAATQDDNDDPDNMTYEQRQALVESVGNENRGLSDLLISYLETWKYKSGFFPRKANHDNCPICLSAFRRRETLITLACKHSYHEGCIARWLKIDKACPVCKYEVFGPS

SEQ ID NO: 673 - DNA, 450 bp, Oryza sativa
atggcggaccagctcaccgacgaccagatcgccgagttcaaggaggccttcagcctcttcgacaaggacggcgatggttgcatcacaaccaaggagctgggaaccgtgatgcgttcgctggggcagaacccaacggaggccgagctccaggacatgatcaacgaggtcgacgcggacggcaacggcaccatcgacttcccggagttcctcaacctgatggcacgcaagatgaaggacaccgactcggaggaggagctcaaggaggcgttcagggtgttcgacaaagaccagaacggcttcatctccgccgccgagctccgccacgtcatgaccaacctcggcgagaagctgaccgacgaggaggtcgacgagatgatccgcgaagccgacgtcgacggtgacggccagatcaactacgaggagttcgtcaaggtcatgatggccaagtga

SEQ ID NO: 674 - protein, 149 aa, Oryza sativa
MADQLTDDQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYEEFVKVMMAK

SEQ ID NO: 675 - DNA, 501 bp, Oryza sativa
atgccgccgaagctcgacccgacccaggtggtggatgtgttcgtccgcgtgaccggcggtgaggtcggcgcggcgtcgtcgctcgcccccaagatcgggccgctcggtctctccccgaagaagatcggagaggacatcgccaaggagaccgccaaggactggaagggcctccgcgtcaccgtgaagctcaccgtccagaaccggcaggccaaggtctccgtcgtcccctccgccgcggcgctcgtcatcaaggcgctcaaggagcccgagagggaccgcaagaaggtgaagaacatcaagcacagcggcaacatcagcctcgacgacgtcatcgagatcgcgagggtcatgaggcccaggtccatggccaaggagatggccggcaccgtcaaggagatcctcggcacctgcgtcagcgtcggctgcaccgtggacggcaaggaccccaaggacctgcagcaggagatctccgacggcgaggtcgagatcccctcagcttaa

SEQ ID NO: 676 - protein, 166 aa, Oryza sativa; identical to SEQ ID NO: 634

SEQ ID NO: 677 - DNA, 2301 bp, Oryza sativa
  misc_feature (1844)..(1844): n = any nucleotide
  misc_feature (1846)..(1846): n = any nucleotide
atggcgtctcacattgttgggtacccccgcatgggccccaagagggagctcaagtttgccctggagtctttctgggatgggaagagcagcgctgaggatttggagaaggttgcgaccgacctcagggccagcatctggaagcaaatggctgacgctgggatcaagtacatccccagcaacaccttctcgtactatgatcaggttcttgacacggctgccatgcttggtgctgtcccagagcgctactcatggactggtggagagattgggttcagcacctacttctcgatggctaggggcaatgccactgtccctgccatggagatgaccaagtggtttgacaccaactaccactttatcgtccctgaacttggtcccaacaccaagttctcctactcttcccacaaggctgtgaatgaatacaaggaggctaaggcgctcggcgttgacaccgtgccagtacttgttggaccagtttcatacttgttgctctccaaacctgccaagggtgtagagaagtcgttcgctcttctttcccttctgagcagcatccttcctgtctacaaggaggttattgctgagttgaaggcagctggtgctacttggattcagtttgatgaacccacacttgttcttgaccttgactctcaccaattggctgcattctctgctgcatacacagaacttgagtcggcactttctggattgaatgtgcttattgagacatacttcgctgacattcctgctgaatcatacaagaccctcacatccctgaacagcgtgactgcttatggttttgaccttatccgtggagccaagactcttgaccttatcaagagtgctggtttcccctctggaaagtacctctttgccggtgttgtggatggacgcaacatctgggctgatgatctcgctgcatctctcactacccttgagtctcttgaggctattgttggaaaggacaagcttgtggtctcgacttcctgctcactcatgcacaccgctgtggatcttgtaaatgagaccaagctcgatagcgagattaagtcatggctcgcttttgctgcccaaaaggtggttgaggtgaatgcccttgctaaggcattggctggacagaaggatgaggcttactttgcagcaaacgctgctgctcaggcctccaggaggtcatcacctcgtgtgacaaacgaggaagtccaaaaggctgctgctgctctgaaggggtctgaccaccgccgtgctaccaatgttagcgctagactggacgcacagcagaagaagctcaaccttccagtccttcctacaaccacaattggttcattcccacagactgtggagctcaggagagtccgccgtgagtacaaggcaaaaaagatctctgaggaggagtacatcagtgccatcaaggaggaaatcagcaaggttgttaagatccaggaagagcttgacatcgatgtccttgttcacggcgagcctgagagaaacgatatggttgagtacttcggtgagcagctttctggttttgcattcactgccaacggatgggtgcaatcttatggatcacggtgtgtcaagccaccaattatctatggtgatgtgagccgccccaaccccatgactgtgttctggtccaagttggcgcagagcatgacctctcgccccatgaagggaatgttgactggtcccgtcacaatccttaactggtcttttgtcaggaatgaccagccgaggtttgagacatgctaccagattgctcttgccatcaagaaggaggtcgaggaccttgaggctggtggtattcaggtcatccaaatcgatgaggctgctttgagagaaggtctgcnantccgcaaggcggagcatgctttctacttggactgggctgttcactccttcagaatcaccaactgcggtgttcaggacaccacccagatccacacccacatgtgctactctaacttcaacgacatcatccactccatcatcaacatggacgctgatgtgatcaccatcgagaactcccggtccgacgagaagctgctctccgtcttccgcgagggtgtgaagtatggtgctggcattggccctggtgtctatgacatccactccccaaggatcccgtccacagaggagattgcggaccgcgtcaacaagatgctcgcggtgctcgacactaacattctctgggtgaaccctgactgcggtctcaagacccgcaagtacaacgaggtcaagcccgcccttaccaacatggtttcggccgccaagctcatccgcacccagctcgccagcgcgaagtga

SEQ ID NO: 678 - protein, 766 aa, Oryza sativa
MASHIVGYPRMGPKRELKFALESFWDGKSSAEDLEKVATDLRASIWKQMADAGIKYIPSNTFSYYDQVLDTAAMLGAVPERYSWTGGEIGFSTYFSMARGNATVPAMEMTKWFDTNYHFIVPELGPNTKFSYSSHKAVNEYKEAKALGVDTVPVLVGPVSYLLLSKPAKGVEKSFALLSLLSSILPVYKEVIAELKAAGATWIQFDEPTLVLDLDSHQLAAFSAAYTELESALSGLNVLIETYFADIPAESYKTLTSLNSVTAYGFDLIRGAKTLDLIKSAGFPSGKYLFAGVVDGRNIWADDLAASLTTLESLEAIVGKDKLVVSTSCSLMHTAVDLVNETKLDSEIKSWLAFAAQKVVEVNALAKALAGQKDEAYFAANAAAQASRRSSPRVTNEEVQKAAAALKGSDHRRATNVSARLDAQQKKLNLPVLPTTTIGSFPQTVELRRVRREYKAKKISEEEYISAIKEEISKVVKIQEELDIDVLVHGEPERNDMVEYFGEQLSGFAFTANGWVQSYGSRCVKPPIIYGDVSRPNPMTVFWSKLAQSMTSRPMKGMLTGPVTILNWSFVRNDQPRFETCYQIALAIKKEVEDLEAGGIQVIQIDEAALREGLQLRKAEHAFYLDWAVHSFRITNCGVQDTTQIHTHMCYSNFNDIIHSIINMDADVITIENSRSDEKLLSVFREGVKYGAGIGPGVYDIHSPRIPSTEEIADRVNKMLAVLDTNILWVNPDCGLKTRKYNEVKPALTNMVSAAKLIRTQLASAK

SEQ ID NO: 679 - DNA, 1023 bp, Oryza sativa
  misc_feature (14)..(14): n = any nucleotide
  misc_feature (102)..(102): n = any nucleotide
  misc_feature (124)..(124): n = any nucleotide
  misc_feature (788)..(788): n = any nucleotide
atgtcgacgccganagcggcggcgagcctcgccaagaaggcggcgctggtggcgctggccgtcctggccgcggcgctcgcgacggcggcgcgcgccgagcantgcggcgcgcaggccggcggcnccaggtgcccgaactgcctctgctgcagccgctggggctggtgcggcaccacctccgacttctgcggcgacggctgccagagccagtgcagcggctgcggcccgacgccgacgccgacgccgccgagcccctccgacggcgtgggctccatcgtgcccagggacctgttcgagcggctcctcctccaccgcaacgacggggcgtgccccgcgcgcgggttctacacctacgaggccttcctcgccgccgccgccgcgttcccggcgttcggcggcaccggcaacaccgagacgcggaagcgggaggtcgccgcgttcctgggccagacctcccacgagaccaccggcgggtggccgaccgcgcccgacggccccttctcctggggctactgcttcaagcaggagcagaacccgccgtccgactactgccagccctcgccggagtggccgtgcgcccccggccgcaagtactacggccgcggccccatccaactctccttcaacttcaactacgggccggcggggaaggcgatcggggtggacctgctgagcaacccggacctggtggcgacggacgcgacggtgtcgttcaagacggcgctgtggttctggatgacgccgcaggggaacaagccgtcgagccacgacgtgatcacggggcggtnggcgccctcgccggccgacgccgcggcggggcgggcgccggggtacggcgtgatcaccaacatcgtcaacggcgggctggagtgcgggcacggccccgacgaccgcgtggcgaaccggatcggcttctaccagcgctactgtggcgcgttcggcatcggcaccggcggcaacctcgactgctacaaccagaggccgttcaacagcggctcgtcggttgggttggcggagcagtga

SEQ ID NO: 680 - protein, 340 aa, Oryza sativa
MSTPTAAASLAKKAALVALAVLAAALATAARAEHCGAQAGGPRCPNCLCCSRWGWCGTTSDFCGDGCQSQCSGCGPTPTPTPPSPSDGVGSIVPRDLFERLLLHRNDGACPARGFYTYEAFLAAAAAFPAFGGTGNTETRKREVAAFLGQTSHETTGGWPTAPDGPFSWGYCFKQEQNPPSDYCQPSPEWPCAPGRKYYGRGPIQLSFNFNYGPAGKAIGVDLLSNPDLVATDATVSFKTALWFWMTPQGNKPSSHDVITGRSAPSPADAAAGRAPGYGVITNIVNGGLECGHGPDDRVANRIGFYQRYCGAFGIGTGGNLDCYNQRPFNSGSSVGLAEQ

SEQ ID NO: 681 - DNA, 447 bp, Oryza sativa
atggcgatgagaagggtggtgctggtggcggcggtgctgtgcgcggtggtcgccatggtcacagcgcaggaggcatccaacgtgcgcgccacgtatcactactatcgccccgcgcagaacaactgggacttaggagccccagccgtgagcgcgtattgtgctacgtgggacgctaacaagccactgtcgtggcgtcagaagtatggctggactgccttttgcgggcccgttggtcctaggggtcaggctgcatgtggcaagtgccttctggtgacgaacacggcgacgggggcgcagatcacggcgaggatcgtggaccagtgcgccaatggcggccttgacctggactgggacaccgtcttcaccaagatcgacaccgacggccagggctaccagaagggccacctcatcgtcaactacaagttcgtcgactgcggcgacaactga

SEQ ID NO: 682 - protein, 148 aa, Oryza sativa
MAMRRVVLVAAVLCAVVAMVTAQEASNVRATYHYYRPAQNNWDLGAPAVSAYCATWDANKPLSWRQKYGWTAFCGPVGPRGQAACGKCLLVTNTATGAQITARIVDQCANGGLDLDWDTVFTKIDTDGQGYQKGHLIVNYKFVDCGDN

SEQ ID NO: 683 - DNA, 2142 bp, Oryza sativa
atggagtgcgagaacggccgcgtttctgccaatggcatgagtggtctctgcgtcgcggcgccccgcgccgacccgctgaactgggggaaggccacggaggagatgacggggagccacctcgacgaggtgaagaggatggtggcggagtaccgccagcctctggtcaagatcgagggcgctagcctgaggatcgcgcaggtcgccgcggtggccgcggccggcgaggccagggtggagctcgacgagtcggcccgcgagcgcgtcaaggccagcagcgactgggtgatgaacagcatgatgaacggcacggacagctacggtgtcaccaccggtttcggcgccacgtcccacaggaggaccaaggagggtggtgctctgcaaagagagctcatcagattcctcaatgccggcgcgttcggcactggcaccgacggtcatgttttgccggcggaggcaacccgcgcggcaatgctcgtccgcatcaacacactcctccagggatactccggcatccggttcgagatcctcgaggcgatcgccaagctgctcaacgcgaacgtcacaccgtgcctgccgctccggggcacgatcaccgcctccggtgacctcgtcccgctgtcctacattgccggccttgtcactgggcgcgagaacgccgtggcggttgcaccagatggcagcaaggtgaacgccgctgaggcgttcaagattgctggcatccagggcggcttcttcgagctgcagcccaaggaaggccttgccatggtcaatggcactgccgtgggctctggccttgcatcgaccgtgctctttgaggctaacattcttgccatcctcgccgaggtcctctcggccgtgttctgcgaggtgatgaacggcaagccggagtacaccgaccacctgactcacaagctcaagcaccatccaggacagatcgaggccgccgccatcatggagcacatcttggagggaagctcctacatgaagcatgccaagaagcttggtgagctcgacccactgatgaagccgaagcaagaccggtacgcgctccggacatccccacagtggctcggccctcaaattgaggttatccgcgccgccaccaagtccatcgagcgtgagatcaactccgtgaacgacaacccgctcatcgacgtctcccgcggcaaggcgctgcacggtggcaacttccagggcacgcccatcggcgtgtccatggacaacacccgcctcgccatcgctgccatcggcaagctcatgttcgcgcagttctcggagctcgtgaacgacttctacaacaacggcctgccatccaacctgtctggcggtcgcaacccgagcttggactacgggttcaagggcgccgagatcgccatggcctcctactgctccgagctgcagttcttgggcaacccagtgaccaaccacgtccagagcgccgagcagcacaaccaggacgtcaactctcttggactcatctcctccaggaagaccgacgaggcaatcgacatcctgaagctcatgtcctccacgttcttgatcgccctctgccaggccgtcgacctgcggcacatcgaggagaacgtcaagagcgccgtcaagagctgcgtcatgacggtggccaagaagacactcagcaccaactccaccggcgatctccacgtcgcacgcttctgcgagaaggacctgctcaaggagatcgaccgcgaggcggtgttcgcgtacgcggacgacccgtgcagccacaactacccgctgatgaagaagctgcgcaacgtgctcgtggagcgcgccctcgccaacggcgcggccgagttcaacgccgacacctcggtgttcgccaaggtcgcgcagttcgaggaggagctgcgcgcgactctgccaggtgcgatcgaggccgcacgtgcggctgtggagaacggcacggcggcgattcccagcagaatcaccgagtgcaggtcgtatccgctctaccggttcgtgcgcgaggagctcggaacaaagtacctgaccggcgagaagacacgatcgcctggcgaggagctgaacaaggttcttgtggctatcaacgaaggcaagcacatcgacccgttgctcgagtgcctcaaggagtggaacggcgagcccctgccaatctgctga

SEQ ID NO: 684 - protein, 713 aa, Oryza sativa
MECENGRVSANGMSGLCVAAPRADPLNWGKATEEMTGSHLDEVKRMVAEYRQPLVKIEGASLRIAQVAAVAAAGEARVELDESARERVKASSDWVMNSMMNGTDSYGVTTGFGATSHRRTKEGGALQRELIRFLNAGAFGTGTDGHVLPAEATRAAMLVRINTLLQGYSGIRFEILEAIAKLLNANVTPCLPLRGTITASGDLVPLSYIAGLVTGRENAVAVAPDGSKVNAAEAFKIAGIQGGFFELQPKEGLAMVNGTAVGSGLASTVLFEANILAILAEVLSAVFCEVMNGKPEYTDHLTHKLKHHPGQIEAAAIMEHILEGSSYMKHAKKLGELDPLMKPKQDRYALRTSPQWLGPQIEVIRAATKSIEREINSVNDNPLIDVSRGKALHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISSRKTDEAIDILKLMSSTFLIALCQAVDLRHIEENVKSAVKSCVMTVAKKTLSTNSTGDLHVARFCEKDLLKEIDREAVFAYADDPCSHNYPLMKKLRNVLVERALANGAAEFNADTSVFAKVAQFEEELRATLPGAIEAARAAVENGTAAIPSRITECRSYPLYRFVREELGTKYLTGEKTRSPGEELNKVLVAINEGKHIDPLLECLKEWNGEPLPIC

SEQ ID NO: 685 - DNA, 2028 bp, Oryza sativa
  misc_feature (696)..(696): n = any nucleotide
atgcagctggggcttctcctcgccgcgcttctcctcttcacgtcgtcgctggccggctctgtggcggctgccgcaccgccgccgccggcgggggccaagggtggtggtgccaagagcggcggcggcggcggcaccgtgatcgggatcgacctcggcacgacgtactcgtgcgtcggcgtctaccggaacgaccgtgtcgagatcatcgccaacgaccaggggaaccggatcacgccctcgtgggtcgccttcaccgacggcggcgagcggctcatcggcgaggcagccaagaaccaggcggcggccaacccggagcggaccatctacgacgccaagcggctcatcggccggcagttctccgacgccgaggtgcagcgcgacatgaagctgctgccgttcgccgtcgtcgaccggaacggcaagccgcacgtgcgcgtcgaggtgaaggacggcgacgtgcgcgtgttcagcccggaggaggtgagcgccatggtgctcacccggatgaaggagacggccgaggcctacctcggcgagaaggtcacgcgcgccgtcgtcaccgtcccggcctacttcaacgacgcgcagcggcaggccaccaaggacgccggcgtcatcgccgggctcaccgtcgaccgcatcatcaacgagccgaccgccgccgccatcgcctacggcatcgacaagaagggcgcngagaagaacgtcctcgtcttcgacctcggcggcggcacgttcgacgtcagcatcctcgccatcgacaacggcgtgttcgaggtccttgccaccaacggcgacacccacctcggcggcgaggacttcgaccaacgcctcatggaccacttcgtcaaggtcatccgccggaagcacgggcgcgacatcgccggcgacgcgcgcgcgctgggcaagctccgccgcgagtgcgagcgcgccaagcgcgcgctcagcaaccagcaccaggtgcgcgtcgagatcgagtccctgttcgacggcgtcgacttctcggagccgctctcccgggcgcggttcgaggagctcaacggcgacctcttcaagaagacgatggtgccggtgaggaaggccatggcggacgccgggctgggcaagggcgacatcgacgagatcgtcctcgtcggcggcagcaccaggatccccaaggtgcagcagctgctcaaggactacttcggtggcaaggagcccaaccgcggcgtcaaccccgacgaggccgtggcgtacggcgccgccgtgcaggccagcatcatcagcggccacgtcgacgagaacacggagagcatgatcctcctcgacgtcgcgccgctcaccctcggcctggagacggccggcggcgtgatgaccaagctgatcccgcgcaacacggtggtgccgacgaagaagacgcaggtgttcaccacgtacaaggacaggcagacgacggtgaccatccaggtgttcgagggcgagcggagcatgacgagggacaaccggctgctcggcaagttcgacctcaccggcatcgcgccggcgccgaggggggcgccgcagatcgcggtgacgttcgaggtggacgccaacggcatcctcagcgtgctggccgccgacaaggccaccggcaggtcggagaagatcaccatctccggcgacgaccgcaagatcagccaggaggagatcgaccggatggtgcgcgaggcggaggagttcgccgacgaggaccgccggcacagggagcaggtggacgcccggaacagcctggaggcgtacgtctacaacgtcaagagcacgctcggcggcaagatggcggacgccatggagggggaggagaaggagaaggtggaggaggcggtgagggaggcgcacgagtggctggacggcaacccggacgccggcaaggaggagtacgaggagaagctgcgggagctggaggacgtgtgcaaccccgtcatgtcggcggtgtaccagaggtccggcggcggcggcggcgcaccggaagatggcaacgtcgacgacgaggatgaccacgatgagctttag

SEQ ID NO: 686 - protein, 675 aa, Oryza sativa
MQLGLLLAALLLFTSSLAGSVAAAAPPPPAGAKGGGAKSGGGGGTVIGIDLGTTYSCVGVYRNDRVEIIANDQGNRITPSWVAFTDGGERLIGEAAKNQAAANPERTIYDAKRLIGRQFSDAEVQRDMKLLPFAVVDRNGKPHVRVEVKDGDVRVFSPEEVSAMVLTRMKETAEAYLGEKVTRAVVTVPAYFNDAQRQATKDAGVIAGLTVDRIINEPTAAAIAYGIDKKGAEKNVLVFDLGGGTFDVSILAIDNGVFEVLATNGDTHLGGEDFDQRLMDHFVKVIRRKHGRDIAGDARALGKLRRECERAKRALSNQHQVRVEIESLFDGVDFSEPLSRARFEELNGDLFKKTMVPVRKAMADAGLGKGDIDEIVLVGGSTRIPKVQQLLKDYFGGKEPNRGVNPDEAVAYGAAVQASIISGHVDENTESMILLDVAPLTLGLETAGGVMTKLIPRNTVVPTKKTQVFTTYKDRQTTVTIQVFEGERSMTRDNRLLGKFDLTGIAPAPRGAPQIAVTFEVDANGILSVLAADKATGRSEKITISGDDRKISQEEIDRMVREAEEFADEDRRHREQVDARNSLEAYVYNVKSTLGGKMADAMEGEEKEKVEEAVREAHEWLDGNPDAGKEEYEEKLRELEDVCNPVMSAVYQRSGGGGGAPEDGNVDDEDDHDEL

SEQ ID NO: 687 - DNA, 2124 bp, Oryza sativa
atggcgagccagaccgccgacgccacggggttcgtcgcgagcgacccgctgtcgtggggcaaggcggcgctggagatgacggggagccacctggacgaggtgaagcgcatggtggcgcagtcacgggaggccgtggtgaagatcgaggggtccagcctccgcgtcggccaggtggccgccgtctccgcggccaaggacgcctccggcgtggtggtcgagctggacgaggaggcccgcccccgcgtcaaggccagcagcgagtggatcctcaactgcatcgcccacggcggcgacatctacggcgtcaccaccggcttcggcggcacctcccaccgccgcaccaaggacggccaggccctccaagttgagctgctcaggcatctcaatgccggaatcttcggcaacggctccgatggcaactcgctgccgtcggaggtgtcgcgtgcggcgatgcttgtgcgcatcaacaccctgctccagggctactcgggcatccgcttcgagatcctcgaggcgatcaccaagctgatcaacaccggggtcagcccatgcctgccgctccgaggcaccatcacggcgtccggcgacctcgtgccgctgtcctacattgccggcctcatcaccgggcgccccaacgcgcaggcggtgaccgtcgatggcaagaaggtggacgccgccgaggcgttcaagatcgccggcatccagggcggcttcttcaggctggagcccaaggaaggtctcgccatcgtgaacggcacctccgtgggctcggccctcgctgccatggtgctctacgacgcgaacgtcctcgccgtcctgtccgaggtgctgtccgccgtgttctgcgaggtgatgaacggcaagcccgagtacaccgaccacctgacgcacaagctgaagcaccacccgggctcgatcgaggccgccgccatcatggagcacatcctcgccggcagcgcgttcatgccgcacgcgcagaaggtgaacgaggtggacccgctgctgaagccgaagcaggacaggtacgcgctccgcacgtcgccgcagtggctgggaccccagatcgaggtcatccgcgcggccaccaagtcgatcgagcgcgaggtcaactcggtgaacgacaacccggtcatcgacgtccaccgcggcaaggccctgcacggcggcaacttccagggcacgcccatcggcgtgtccatggacaacacccgcctcgccatcgccaacatcggcaagctcatgttcgcccagttctccgagctggtcaacgagttctacaacaacgggctcacgtcaaacctggccggcagccgcaacccgagcttggactacggcttcaagggcaccgagatcgccatggcctcctactgctcggagctccagttcctcgccaacccggtcaccaaccacgtccagagcgcggagcagcacaaccaggacgtcaactccctcggcctcgtctccgccaggaagaccgccgaggcggtggacatcctcaagctcatgtcctccacctacctggttgcgctctgccaggccgtcgacctgcgccacctggaggagaacctcaagagcgccgtcaagaactgcgtgacgacggtggccaagaaggtgctcaccacgggccccgccggcggcctccacagcgcgcgcttcagcgagaaggccctgctcaccgccatcgaccgcgaggccgtgtacagctacgccgacgacccgtgcagcgccaactacccgctgatgaccaagatccgcgccgtgctcgtcgagcacgccctcgccaacggccccgccgagaaggacgacggctcctccgtgttctccaagatcaccgcgttcgaggaggagctccgcgaggcgctgcccagggagatggaggcggcgcgcgtggcgttcgagaccggcaccgcgccgatcaccaacaggatcaaggagagcaggtcgttcccgctgtaccgcttcgtccgcgaggagctcggctgcgtgtacctcaccggagagaagctcaagtcccccggcgaggagtgcaacaaggtgttcctggccatcagcgagcgcaagctcatcgacccgatgctcgagtgcctcaaggagtggaacggcgagcccctgcccatctgctga

SEQ ID NO: 688 - protein, 707 aa, Oryza sativa
MASQTADATGFVASDPLSWGKAALEMTGSHLDEVKRMVAQSREAVVKIEGSSLRVGQVAAVSAAKDASGVVVELDEEARPRVKASSEWILNCIAHGGDIYGVTTGFGGTSHRRTKDGQALQVELLRHLNAGIFGNGSDGNSLPSEVSRAAMLVRINTLLQGYSGIRFEILEAITKLINTGVSPCLPLRGTITASGDLVPLSYIAGLITGRPNAQAVTVDGKKVDAAEAFKIAGIQGGFFRLEPKEGLAIVNGTSVGSALAAMVLYDANVLAVLSEVLSAVFCEVMNGKPEYTDHLTHKLKHHPGSIEAAAIMEHILAGSAFMPHAQKVNEVDPLLKPKQDRYALRTSPQWLGPQIEVIRAATKSIEREVNSVNDNPVIDVHRGKALHGGNFQGTPIGVSMDNTRLAIANIGKLMFAQFSELVNEFYNNGLTSNLAGSRNPSLDYGFKGTEIAMASYCSELQFLANPVTNHVQSAEQHNQDVNSLGLVSARKTAEAVDILKLMSSTYLVALCQAVDLRHLEENLKSAVKNCVTTVAKKVLTTGPAGGLHSARFSEKALLTAIDREAVYSYADDPCSANYPLMTKIRAVLVEHALANGPAEKDDGSSVFSKITAFEEELREALPREMEAARVAFETGTAPITNRIKESRSFPLYRFVREELGCVYLTGEKLKSPGEECNKVFLAISERKLIDPMLECLKEWNGEPLPIC

SEQ ID NO: 689 - DNA, 1086 bp, Oryza sativa
  misc_feature (18)..(18): n = any nucleotide
  misc_feature (51)..(51): n = any nucleotide
  misc_feature (724)..(724): n = any nucleotide
atgaaggcgctcattctngttggaggcttcggcactcgccttcggcctttnacgctcagtttcccaaagcctcttgttgatttcgcgaacaagcccatgattctgcatcagattgaggccttgaaagaagttggagtaacagaagttgttttagccatcaactaccgcccggaggtaatgctcaatttcctgaaggactttgaggataagcttggcatcacaatcacgtgttcccaagagactgagcccttgggaactgctggccctcttgctctagcaagggacaagcttgtggatggatctggtgagccattctttgtcctcaacagtgacgtcataagtgaatacccttttgctgagctcataaaatttcacaagagccatggtggtgaggcaacgattatggtcaccaaggtggacgaaccatcaaaatatggtgttgtggttatggaggaggtcactggaatggtggaaaaatttgttgagaaaccaaaaatatttgtaggcaacaagatcaatgcgggaatttacttgttgaatccatctgtcctggaccgcatcgagctgaagccaacttcaattgagaaagaggtctttcctcgaattgcatctgatgcaaagctctttgctctggtccttccaggtttttggatggatgttggccaaccaagggattacattacaggcttgcgcctttatctggattcacttaggaagagatcanccaacaggttagccactggagcacacattgttgggaatgtgctagttcacgagagtgcgaagattggcgaaggctgtctgattggtcctgatgttgctattggtcctggatgcgtcgtggaggatggtgtgaggctttcccgttgcacggtgatgcgtggcgtgcgtattaagaagcatgcttgcatatcaaacagcattattggatggcactcaactgttggacaatgggcacggatagaaaatatgactatcctaggagaggacgtacatgtaggtgatgaggtctataccaacggcggtgttattctcccgcacaaagagatcaaatcaagcatcctgaaacctgagattgtcatgtga

SEQ ID NO: 690 - protein, 361 aa, Oryza sativa
MKALILVGGFGTRLRPFTLSFPKPLVDFANKPMILHQIEALKEVGVTEVVLAINYRPEVMLNFLKDFEDKLGITITCSQETEPLGTAGPLALARDKLVDGSGEPFFVLNSDVISEYPFAELIKFHKSHGGEATIMVTKVDEPSKYGVVVMEEVTGMVEKFVEKPKIFVGNKINAGIYLLNPSVLDRIELKPTSIEKEVFPRIASDAKLFALVLPGFWMDVGQPRDYITGLRLYLDSLRKRSPNRLATGAHIVGNVLVHESAKIGEGCLIGPDVAIGPGCVVEDGVRLSRCTVMRGVRIKKHACISNSIIGWHSTVGQWARIENMTILGEDVHVGDEVYTNGGVILPHKEIKSSILKPEIVM

SEQ ID NO: 691 - DNA, 1992 bp, Oryza sativa
atggcggcttacgagcccaagaacattcttataaccggcgctgctggtttcatcgcatcacatgtggcgaaccgcctagtcaggaactatccgcactacaagattgttgtcctcgacaagctcgattactgttccagcctgagcaatctcaacccttcacgtccatcgccgaatttcaagtttgtcaagggtgacattgcaagtgctgatctggtgaactaccttctcacaactgagtcaattgacactatcatgcactttgctgctcagactcatgtggataattcatttggcaattcctttgagtttacaaagaacaatatttatggtacccatgtccttcttgaggcctgcaaggttactggtcagattagaagatttattcatgtgagtactgacgaggtgtacggagaaactgatgaggatgctgtggttggcaaccatgaggcctcacagctgcttccaacaaacccatattcagctacaaaagctggggctgagatgcttgtgatggcttatggaagatcttatggccttcctgtgattacaactcggggcaacaatgtatatgggccaaatcagttccctgagaagctcattcccaaatttattcttttggcaatgagaggcttgccccttcccattcacggtgatggctcaaatgtcagaagctatctgtattgtgaggatgttgctgaagcttttgaggtggttcttcacaaaggagaggttgggcatgtgtacaatattggtactgtgaaggaaaggagggtgattgatgtggccaaggacatatgcaagctctttggcttggacaccgagaaggtcatcagatttgttgagaacaggcctttcaacgaccagagatacttcttggatgatcagaagctgaagaaattgggatgggcagagcgcacactatgggaagaggggttgaagaaaacaattgaatggtacactaacaatcctgattactggggagatgtcgcaggtgccttgctccctcatccaaggatgttgatgacacctggagttgaaaggcataactggactgatgagatcaaatctctttccacttcaccagatgaagctaaggaatctagcactgcggttcctgcagccactgccaaaagcaccagcagtgcccctcaaaaggcctcatacaagttcttgatatatggtaggactggatggattggtggtctacttggtaagatatgtgagaagcaagggattccatatgagtatgggaaaggacgcctggaagagcgctctcagctcttgcaggacattagaaatgtgaagccaactcatgttttcaatgctgctggtgtcactgggaggccaaatgttgactggtgcgagacccataaacaggatactatccgcaccaatgttgttggcaccttgaaccttgctgatgtttgtcgttgcatatttgagtatgatgctaagcaccccgaaggatcaggaattggttttaaagaggaagataagcccaactttactggttcatattattccaaaactaaagctatggttgaagagctgttgcaagaatatgacaacgtctgtacgcttcgagtcaggatgcccatatcatcagatttgagcaacccccgtaacttcatcacaaagatagctcgttatgacaaggtggtaaacatccccaacagtatgacaattttggatgagcttttgcccatctccattgagatggcgaagcgggactgcaggggcatatggaacttcaccaatcctggggttgtcagccacaacgagatcctggagatgtacaagaaatacctcaaccccgacttcaagtggaccaacttcactcttgaggaacaggccaaggttatagttgcaccaagaagtaacaacgaaatggatgcatcgaagttgaagtccgagttccccgagctactgtccatcaaggattctttggttaagtatgtttttgagccaaacaggaaggttcctgctaactga

SEQ ID NO: 692 - protein, 663 aa, Oryza sativa
MAAYEPKNILITGAAGFIASHVANRLVRNYPHYKIVVLDKLDYCSSLSNLNPSRPSPNFKFVKGDIASADLVNYLLTTESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGLPLPIHGDGSNVRSYLYCEDVAEAFEVVLHKGEVGHVYNIGTVKERRVIDVAKDICKLFGLDTEKVIRFVENRPFNDQRYFLDDQKLKKLGWAERTLWEEGLKKTIEWYTNNPDYWGDVAGALLPHPRMLMTPGVERHNWTDEIKSLSTSPDEAKESSTAVPAATAKSTSSAPQKASYKFLIYGRTGWIGGLLGKICEKQGIPYEYGKGRLEERSQLLQDIRNVKPTHVFNAAGVTGRPNVDWCETHKQDTIRTNVVGTLNLADVCRCIFEYDAKHPEGSGIGFKEEDKPNFTGSYYSKTKAMVEELLQEYDNVCTLRVRMPISSDLSNPRNFITKIARYDKVVNIPNSMTILDELLPISIEMAKRDCRGIWNFTNPGVVSHNEILEMYKKYLNPDFKWTNFTLEEQAKVIVAPRSNNEMDASKLKSEFPELLSIKDSLVKYVFEPNRKVPAN

SEQ ID NO: 693 - DNA, 1017 bp, Oryza sativa
  misc_feature (614)..(614): n = any nucleotide
  misc_feature (618)..(618): n = any nucleotide
  misc_feature (620)..(620): n = any nucleotide
atggctaagatgggtttcgctcccatgctttcagtggccgtgctccttggaaccttggcagcatttcctgcagcggtacactccatcggcgtgtgttacggcgtggtcgccaacaacctgcccgggccgagcgaagtcgtgcagctgtacagatccaaggggatcgattcgatgcgcatctacttcgcggacgccgccgccctcaatgcactcagcggctcgaacatcggtctcatcatggacgtcggcaacggcaacctctcgagcttagcttccagcccctccgccgcagccggttgggtcagggacaacatccaggcctacccgggcgtctccttccgctacatcgccgtcggcaacgaggttcaaggcagcgacaccgcgaacatccttccggccatgcggaacgtcaacagcgcgctggtggcggccggcctcggcaacatcaaggtatccacgtcggtcaggttcgacgcgttcgccgacaccttcccgccctccagcggcaggttcagggacgactacatgaccccgatcgcgaggttcttggccaccaccggcgcgccgctgttggcgaacgtgtacccctacttcgcctacaaagacgaccaggnaagngngcagaaagacatcatgctcaactacgccaccttccagccgggcacgacggtggtggacaacgggaacaggctgacctacacgtgcctcttcgacgcgatggtcgactccatctacgccgcgctggagaaggccggcacaccgagcgtcagcgtcgtcgtgtccgagagcgggtggccgtccgccggagggaaggttggggccagcgtgaacaacgcgcagacatacaaccaggggctgatcaaccatgtccgaggcggcacgcccaagaagcgcagggcgttggagacttacatatttgctatgttcgacgagaacggcaagcctggggatgagatcgagaagcactttgggctgttcaaccccaataagtcgccatcgtacagcattagtttctaa

SEQ ID NO: 694 - protein, 338 aa, Oryza sativa
MAKMGFAPMLSVAVLLGTLAAFPAAVHSIGVCYGVVANNLPGPSEVVQLYRSKGIDSMRIYFADAAALNALSGSNIGLIMDVGNGNLSSLASSPSAAAGWVRDNIQAYPGVSFRYIAVGNEVQGSDTANILPAMRNVNSALVAAGLGNIKVSTSVRFDAFADTFPPSSGRFRDDYMTPIARFLATTGAPLLANVYPYFAYKDDQARAQKDIMLNYATFQPGTTVVDNGNRLTYTCLFDAMVDSIYAALEKAGTPSVSVVVSESGWPSAGGKVGASVNNAQTYNQGLINHVRGGTPKKRRALETYIFAMFDENGKPGDEIEKHFGLFNPNKSPSYSISF

SEQ ID NO: 695 - DNA, 2145 bp, Oryza sativa
atggagtgcgagaacgggcacgtcgccgccgccgccaacggcagcagcctgtgcgtggctaagccgcgtgccgacccgctcaactgggggaaggcggcggaggagctgtccgggagccatctggacgcggtgaagcgcatggtggaggagtaccgcaggcccgtggtgacgatcgagggcgccagcctgaccatcgcgcaggtcgcggcggtggcctccgccggcgccgccagggtggagctcgacgagtccgcccgcggccgcgtcaaggccagcagcgactgggtcatgaacagcatgatgaacggcaccgacagctacggcgtcaccaccggcttcggcgccacctcccaccggaggaccaaggagggcggcgcgctccagcgagagcttatccggtttcttaatgccggggcgttcggcaacggcgacgacggccacgtgctgccggccgcggcgacgcgggcagccatgctcgtccgcatcaacactctgctccaggggtactctggcatccggttcgagatcctcgagacgatcgccacgctgcttaacgccaacgtgacgccgtgcttgccgctccggggcacgatcaccgcgtccggcgacctcgtcccgctctcctacatcgcgggactcgtcaccggccgaccaaactctgtggcggtgacgcccgatggcaggaaggtggatgccgcggaggcgttcaagatcgccggcatccagcacggcttcttcgagctccagcccaaggaaggcctcgccatggtgaacggcacggccgtcggctccgggctcgcctcgatggtgctctttgaggcgaacgtccttggcgtgctcgcggaggtcctctccgcggtgttctgcgaggtcatgaacggcaagccggagtacaccgaccacctgacgcacaagcttaagcaccacccgggacagattgaggcagccgccattatggagcacatcttggaggggagctcctacatgatgctggcgaagaagctcggcgagctcgacccgctgatgaagcccaagcaagacaggtacgcgctccgcacgtcgccgcaatggctcggcccccagattgaggtcatccgtgccgccaccaagtcgatcgagcgcgagatcaactccgtcaacgacaacccgctcattgacgtctcccgtggcaaggcgctccacggcggcaacttccagggcacacccatcggcgtgtccatggacaacaccaggctcgccattgccgcgatcggtaagctcatgttcgcgcagttctctgagctcgtgaacgatttctacaacaacggcctgccgtccaacctgtccggtgggcgcaacccgagcttggactacggcttcaagggtgccgagatcgccatggcatcgtactgctctgagctccagttcttggccaaccctgtgaccaaccatgtccagagcgcggagcagcacaaccaagacgtcaactctctcggcctcatctcgtccaggaagacggccgaggccatcgacgtgctcaagctcatgtcctcgacgttcttgatcgcgctatgccaggccatcgacctgcgccacctcgaagagaacgtcaggagcgccgtcaagggctgcgtgacgacggtggcgaggaagaccctgagcaccagcgccaccggcgacctccacaaggcccggttctgcgagaaggacctgctccaggcgatcgaccgcgaggccgtgttcgcgtacgcggacgacccctgcagcgccaactacccgctgatgcagaagatgcgcgccgtcctcatcgagcacgcgctggccaacggcgaggcggagcgcaacgtcgacacctcggtgttcgccaaggtcgcgacgttcgaggaggagctccgcgtggcgctgcccagggaggtggaggctgcccgtgcggccgtggagaacggcaccgccgcaaaggcgaacaggatcaccgagtgcaggtcgtacccgctctaccggttcgtccgcgaggagctcgggacagagtacttgaccggggagaagacgcggtcgcccggcgaggaggtgaacaaggtgttcgtcgccatgaaccagggcaagcacatcgacgcactgctcgagtgcctcaaggagtggaacggcgagcctctgcccatctgctga

SEQ ID NO: 696 - protein, 714 aa, Oryza sativa
MECENGHVAAAANGSSLCVAKPRADPLNWGKAAEELSGSHLDAVKRMVEEYRRPVVTIEGASLTIAQVAAVASAGAARVELDESARGRVKASSDWVMNSMMNGTDSYGVTTGFGATSHRRTKEGGALQRELIRFLNAGAFGNGDDGHVLPAAATRAAMLVRINTLLQGYSGIRFEILETIATLLNANVTPCLPLRGTITASGDLVPLSYIAGLVTGRPNSVAVTPDGRKVDAAEAFKIAGIQHGFFELQPKEGLAMVNGTAVGSGLASMVLFEANVLGVLAEVLSAVFCEVMNGKPEYTDHLTHKLKHHPGQIEAAAIMEHILEGSSYMMLAKKLGELDPLMKPKQDRYALRTSPQWLGPQIEVIRAATKSIEREINSVNDNPLIDVSRGKALHGGNFQGTPIGVSMDNTRLAIAAIGKLMFAQFSELVNDFYNNGLPSNLSGGRNPSLDYGFKGAEIAMASYCSELQFLANPVTNHVQSAEQHNQDVNSLGLISSRKTAEAIDVLKLMSSTFLIALCQAIDLRHLEENVRSAVKGCVTTVARKTLSTSATGDLHKARFCEKDLLQAIDREAVFAYADDPCSANYPLMQKMRAVLIEHALANGEAERNVDTSVFAKVATFEEELRVALPREVEAARAAVENGTAAKANRITECRSYPLYRFVREELGTEYLTGEKTRSPGEEVNKVFVAMNQGKHIDALLECLKEWNGEPLPIC

SEQ ID NO: 697 - DNA, 651 bp, Oryza sativa
atggcgagggtacagctctgggtggccgccgcgtgcgccgtcgtgctcgcgctcgccgcgccctcgctcgccggcgaccccgacatgctccaggacgtctgcgtcgccgacttggcgtccccggtgaagctgaacgggttcccgtgcaaggcgaacgtgacggcggacgacttcttcttcgcggggctgaagaaccccggcaacaccaacaacccggcggggtcgaacgtgacggcggcgaacgtgcagtcgttcccgggggtgaacacgctgggcgtgtctatggcgaggatcgactacgcgccggggggacagaacccgccgcacacgcacccgcgcgccaccgagatcatcttcgtcctcgagggcgtcctcgaggtgggcttcatcaccactgccaacaagctcttcaccaagactgtcaccgccggcgaggtcttcgtcttcccgcgcggcctcgtccacttccagcagaaccgcggccacggccccgccgccgtcatcgccgccttcaacagccagctccagggcacccaggccatcgccgccacgctcttcgccgccgcgccgcccgtgccgtccgacgtcctcgccaaggccttccgcgtcgacgtcccgcaggtggacgccatcaaggccaagttcaagtga

SEQ ID NO: 698 - protein, 216 aa, Oryza sativa
MARVQLWVAAACAVVLALAAPSLAGDPDMLQDVCVADLASPVKLNGFPCKANVTADDFFFAGLKNPGNTNNPAGSNVTAANVQSFPGVNTLGVSMARIDYAPGGQNPPHTHPRATEIIFVLEGVLEVGFITTANKLFTKTVTAGEVFVFPRGLVHFQQNRGHGPAAVIAAFNSQLQGTQAIAATLFAAAPPVPSDVLAKAFRVDVPQVDAIKAKFK

SEQ ID NO: 699 - DNA, 810 bp, Oryza sativa
  misc_feature (251)..(251): n = any nucleotide
  misc_feature (257)..(257): n = any nucleotide
atgtcgagcgcgtcgtccatggaagcgctccacgccgcggtgctcaaggaggagcagcagcagcacgaggtggaggaggcgacggtcgtgacgagcagcagcgccacgagcggggaggagggcggacacctgccgcaggggtgggcgaagcggaagcggtcgcgccgccagcgatcggaggaggagaacctcgcgctctgcctcctcatgctcgcccgcggcggccaccaccgcgtccaggcgccgcctcngctctnggcttcggcgcccccgccggcaggtgcggagttcaagtgctccgtctgcggcaagtccttcagctcctaccaggcgctcggcggccacaagacgagccaccgggtcaagctgccgactccgcccgcagttcccgtcttggctccggcccccgtcgccgccttgctgccttccgccgaggaccgcgagccagccacgtcatccaccgccgcgtcctccgacggcatgaccaacagagtccacaggtgttccatctgccagaaggagttccccaccgggcaggcgctcggcgggcacaagaggaagcactacgacggtggcgtaggcgccggcgccggcgcatcttcaaccgagctcctggccacggtggccgccgagtccgaggtgggaagctccggcaacggccagtccgccacccgggcgttcgacctcaacctcccggccgtgccggagttcgtgtggcggccgtgctccaagggcaagaagatgtgggacgaggaggaggaggtccagagccccctcgccttcaagaagccccggcttctcaccgcgtaa

SEQ ID NO: 700 - protein, 269 aa, Oryza sativa; identical to SEQ ID NO: 156

SEQ ID NO: 701 - DNA, 1137 bp, Oryza sativa
  misc_feature (37)..(37): n = any nucleotide
atggcgcggcgatcctcccctctcctccagctcctcnttttccccactccctccccctccccctccccgccccatcctctcgccgccgccgccgtctcccgccgcaccgtcacctacatgccgcggccgggggacggcgccccgcgcgccgtcacgctcatcccgggcgacggcatcgggcccctcgtcaccggcgccgtgcggcaggtgatggaggccatgcacgcgccggtctacttcgagtcctacgaggtccgcggcgacatgccgacggttccccccgaggtcatcgactccatccgccgcaacaaggtctgcctcaagggcggcctcgccaccccagtcggcgggggtgtctcctccctcaacgtgcagctccgcaaggagctcgacctctacgcctccctcgtcaactgcttcaacctcccggggctgcccaccaggcacgacaacgtcgacattgtcgtcatcagggagaacaccgagggcgagtactccgggcttgagcacgaggtcgtccctggcgtcgtggagagccttaaggtgatcacaaagttctgctctgaaaggattgccaagtatgcttttgagtacgcgtacctcaacaacagaaagaaagtgactgccgtgcataaagcaaacatcatgaagcttgctgatggtttattcttggagtcttgccgtgaggttgcaacaaagtatcctggaattcaatataatgaaatcatcgtggacaactgttgtatgcagcttgttgctaagcctgaacaatttgatgttatggtcacgccaaatctttatggcaatctggtggctaacacggctgcaggtattgctggaggcactggtgtcatgcctggaggtaatgtgggtcaggaccatgctgtcttcgagcaaggagcttctgcaggaaatgttggaaacgtcaaagttgtggagcagaagaaagctaaccccgttgctctgctcctctcatctgccatgatgttgcggcatttgcaattcccatcattcgctgaccggctggagacggcggtgaagcgtgtcatcgcagaaggcaagtacagaaccaaagacttgggcggcagcagcaccacgcaggaagtcacggatgcagtgatcgcgcatcttgattaa

SEQ ID NO: 702 - protein, 378 aa, Oryza sativa
  misc_feature (13)..(13): Xaa = any naturally occuring amino acid
MARRSSPLLQLLXFPTPSPSPSPPHPLAAAAVSRRTVTYMPRPGDGAPRAVTLIPGDGIGPLVTGAVRQVMEAMHAPVYFESYEVRGDMPTVPPEVIDSIRRNKVCLKGGLATPVGGGVSSLNVQLRKELDLYASLVNCFNLPGLPTRHDNVDIVVIRENTEGEYSGLEHEVVPGVVESLKVITKFCSERIAKYAFEYAYLNNRKKVTAVHKANIMKLADGLFLESCREVATKYPGIQYNEIIVDNCCMQLVAKPEQFDVMVTPNLYGNLVANTAAGIAGGTGVMPGGNVGQDHAVFEQGASAGNVGNVKVVEQKKANPVALLLSSAMMLRHLQFPSFADRLETAVKRVIAEGKYRTKDLGGSSTTQEVTDAVIAHLD

SEQ ID NO: 703 - DNA, 2187 bp, Oryza sativa
atggcgtctcacattgttggatacccccgcatgggccccaagagggagctcaagtttgccctggagtctttctgggatgggaagagcagcgctgaggatttggagaaggttgcgaccgacctcagggccagcatctggaagcaaatggctgacgctgggatcaagtatatccccagcaacaccttctcgtactatgatcaggttcttgacacgaccgccatgcttggtgctgtcccagagcgctactcatggaccggtggagagattgggttcagcacctacttctcgatggctaggggaaatgccactgtccctgctatggagatgaccaagtggtttgacaccaactaccactttatcgtccctgaacttggtcccaacaccaagttctcctactcttcccacaaggctgtgaatgaatacaaggaggccaaggcgctcggcgttgacaccgtgccagtacttgttggaccagtttcatacttgttgctctccaagcctgccaagggtgtagagaagtcgttcgctcttctttcccttctcagcagcatccttcctgtctacaaggaggttattgctgagttgaaggcagctggtgctacatggattcagtttgatgagcccacacttgttcttgaccttgactctcaccaattggctgcattctctgcagcgtacacagaactcgagtcggcactttctggattgaatgtgcttattgagacatacttcgctgacattcctgctgaatcatacaagaccctcacatccctgaacagcgtgactgcttatggttttgaccttatccgtggttccaagactcttgaccttgtcaagagtgctggtttcccctctggcaagtacctctttgctggtgttgtggatggacgcaacatctgggctgatgatctcgccgcatctctcaccaccctcgagtctcttgaggctattgttggaaaggacaagcttgtggtctcgacttcctgctcactcatgcacaccgctgtggatcttgtaaatgagaccaagctcgatagcgagattaagtcatggcttgcttttgctgcccaaaaagtggttgaggtgaatgcccttgctaaggcattggctggacagaaggatgagcatttgaagaaacttctgctcatttatacatttgtgaacaatattgtacaggcttactttgcagcaaacactgctgctcaggcctccaggaggtcatcacctcgtgtgacaaacgaggaagtccaaaaggctgctgctgctctgagggggtctgaccaccgccgtgctaccaatgttagcgctaggttggacgcacagcagaagaagctcaaccttccagtccttcctacaaccacaattggttcattcccacagactgtggagctcaggagagtccgccgtgagtacaaggctaaaaagatctctgaggatgagtacgtcagtgccatcaaggaggaaatcagcaaggttgttaagatccaggaagagcttgacattgatgtgcttgttcacggcgagcctgagagaaacgatatggttgagtactttggtgagcagctttctggttttgcatttactgccaatggatgggtgcaatcctatggatcccggtttgagacatgctaccagattgctcttgccatcaagaaggaggtcgaggaccttgaggctggtggtatacaggtcatccaaatcgatgaggctgctttgagagaaggtctgcccctccgcaaggcggagcatgctttctacttggactgggctgttcactccttcagaatcacaaactgcggtgttcaggacaccacccagattcacacccacatgtgctactctaacttcaacgacatcatccactccatcataaacatggacgccgatgtgatcaccatcgagaactcccggtccgacgagaagctgctctctgtcttccgcgagggtgtgaagtatggtgctggcattggtcctggtgtctacgacatccactcccccaggatcccgtccacggaggagattgcggaccgcatcaacaagatgcttgcggtgctcgacactaacattctctgggtgaaccctgactgcggtctcaagacccgcaagtacaccgaggtgaagcctgccctcaccaacatggttttggccgccaagctcatccgcacccagctcgctagcgcgaagtga

SEQ ID NO: 704 - protein, 728 aa, Oryza sativa
MASHIVGYPRMGPKRELKFALESFWDGKSSAEDLEKVATDLRASIWKQMADAGIKYIPSNTFSYYDQVLDTTAMLGAVPERYSWTGGEIGFSTYFSMARGNATVPAMEMTKWFDTNYHFIVPELGPNTKFSYSSHKAVNEYKEAKALGVDTVPVLVGPVSYLLLSKPAKGVEKSFALLSLLSSILPVYKEVIAELKAAGATWIQFDEPTLVLDLDSHQLAAFSAAYTELESALSGLNVLIETYFADIPAESYKTLTSLNSVTAYGFDLIRGSKTLDLVKSAGFPSGKYLFAGVVDGRNIWADDLAASLTTLESLEAIVGKDKLVVSTSCSLMHTAVDLVNETKLDSEIKSWLAFAAQKVVEVNALAKALAGQKDEHLKKLLLIYTFVNNIVQAYFAANTAAQASRRSSPRVTNEEVQKAAAALRGSDHRRATNVSARLDAQQKKLNLPVLPTTTIGSFPQTVELRRVRREYKAKKISEDEYVSAIKEEISKVVKIQEELDIDVLVHGEPERNDMVEYFGEQLSGFAFTANGWVQSYGSRFETCYQIALAIKKEVEDLEAGGIQVIQIDEAALREGLPLRKAEHAFYLDWAVHSFRITNCGVQDTTQIHTHMCYSNFNDIIHSIINMDADVITIENSRSDEKLLSVFREGVKYGAGIGPGVYDIHSPRIPSTEEIADRINKMLAVLDTNILWVNPDCGLKTRKYTEVKPALTNMVLAAKLIRTQLASAK

SEQ ID NO: 705 - DNA, 963 bp, Oryza sativa
  misc_feature (681)..(681): n = any nucleotide
  misc_feature (687)..(687): n = any nucleotide
atggctcccaggctctgctgctcttctcaattcttgctcgccgtctccttcctggccgccttcgcggccgtctccaacgccggcaaggtggccgtctactgggggcagggggcgggcaacggcgacggcaccctcgccgagacatgcgccaccggcctgtacgacttcgtcaacatcgccttcctcaacgtctacggcagcggccttaccccggtgctcaacctcgccgcccactgcaatccggacgcggggacctgcaagtcgctcagctccgagatcagctcctgccagcagagcggcgtgaaggtgctcctctccctcggcggcgagagaggtcagtactccctctcctccgccgacgacgcgcgtggcgtcgccgactacctctggaacaccttcctcggcggcagctcggactcgcgccccctcggcgacgcggtgctcgacggcatcgacttcgacatagagaaggacggtgaccactacgacgagctggcgatggccctctcgtcgaaatgcaacggcgcgtgcgtgctcacggcggcgccgcagtgcccgtacccggacgcccacctcgacgcggcgatcaagaccggggtgttcagccacgtttgggtgcagttctacaacaaccggcagtgccagtacgccagcggcgacgcgagcgcgctgcaggccgcntgggcncagtggaccgagcggcgtgccggcgcccgcggacgtcttcctgggcctgccgacggcgccggccgctgcaccgagcggaggctacatcgacgcggacacgctgctgtcgcaggtgctaccggcggtggagggcgcggcggcgaactacggcggagtcatgctgtggaatcgctggagagacgtgaccgctggttatggcgccaagttgaaggggaaagtttgaaacaaattaagctacgcctacgaaccattcatattcacaggcgtttgaaataa

SEQ ID NO: 706 - protein, 320 aa, Oryza sativa
MAPRLCCSSQFLLAVSFLAAFAAVSNAGKVAVYWGQGAGNGDGTLAETCATGLYDFVNIAFLNVYGSGLTPVLNLAAHCNPDAGTCKSLSSEISSCQQSGVKVLLSLGGERGQYSLSSADDARGVADYLWNTFLGGSSDSRPLGDAVLDGIDFDIEKDGDHYDELAMALSSKCNGACVLTAAPQCPYPDAHLDAAIKTGVFSHVWVQFYNNRQCQYASGDASALQAAWAQWTERRAGARGRLPGPADGAGRCTERRLHRRGHAAVAGATGGGGRGGELRRSHAVESLERRDRWLWRQVEGESLKQIKLRLRTIHIHRRLK

SEQ ID NO: 707 - DNA, 1452 bp, Oryza sativa
atggcgtaccagggcatcgaccttctctcgacgaaagccgcaggcgatgaccacggcgagaattcatcgtacttcgacgggtggaaggcctacgacacgaacccgttcgacctgcggcacaatcgcgggggtgtcatccagatgggtctcgccgagaaccagctttctctggacctgatcgaggaatggagcaagaaccaccccgaggcatccatttgcacaccggagggcgtctcgcagttcaagaggatcgccaatttccaggattaccacggcctcccggagttcagaaaggcgatggcccagtttatggggcaggtgaggggaggcaaggcaacgtttgaccccgaccgtgtcgtcatgagcggcggcgccaccggcgcccaggagacgctcgccttctgcctcgccaaccccggcgaggccttcctcgtgcccacgccatactacccagctttcgaccgcgactgttgctggaggtcaggaataaagctgctgccgatcgagtgccacagcttcaacgacttcaggctcaccaaggaggccctcgtgtcggcgtacgacggcgcacggaggcagggcatctccgtcaaggggatcctcatcaccaacccgtccaacccgctcggcaccatcaccgaccgcgacacgctggccatgctcgccaccttcgccaccgagcaccgcgtccacctcgtctgcgacgagatctacgcggggtcggtgttcgccacgccggagtacgtgagcatcgccgaggtcatcgagcgcgacgtgccgtggtgcaacagggacctgatccacgtcgtgtacagcctctccaaggacttcggcctccccggcttccgcgtcggcatcatctactcgtacaacgacgccgtcgtggcggccgcgcgcaggatgtccagcttcgggctcgtctcgtcgcagacgcagtacttcctcgccaggatgctctcggacgaggagttcatcggccgcttcctccaggagagcaagtgtcggctggtggcgcggcacgagcggttcacctctggcctccgcgaggtcgggatcggctgcctgcgcggcaacgccgggctgttctcgtggatggacctgcgccgcatgctccgggagaagacggccgaggcggagctggagctttggcgggtgatcgtacaccaggtgaagctgaacgtgtcgcccggcacgtcgttccactgccgcgagcccgggtggttccgcgtttgccacgccaacatggacgacgagaccatggaggtcgcgctcggccggatccacgacttcgtgcgccagcaccagcagcgcagggtcaaggccgagcgctgggccgccaataggcagctccgcctcagcctgccgcaccaccaccacctcagcccagcccatctctccagtccattggcgctcctgtcgccgcagtccccgatggttcgcgccaccagctga

SEQ ID NO: 708 - protein, 483 aa, Oryza sativa
MAYQGIDLLSTKAAGDDHGENSSYFDGWKAYDTNPFDLRHNRGGVIQMGLAENQLSLDLIEEWSKNHPEASICTPEGVSQFKRIANFQDYHGLPEFRKAMAQFMGQVRGGKATFDPDRVVMSGGATGAQETLAFCLANPGEAFLVPTPYYPAFDRDCCWRSGIKLLPIECHSFNDFRLTKEALVSAYDGARRQGISVKGILITNPSNPLGTITDRDTLAMLATFATEHRVHLVCDEIYAGSVFATPEYVSIAEVIERDVPWCNRDLIHVVYSLSKDFGLPGFRVGIIYSYNDAVVAAARRMSSFGLVSSQTQYFLARMLSDEEFIGRFLQESKCRLVARHERFTSGLREVGIGCLRGNAGLFSWMDLRRMLREKTAEAELELWRVIVHQVKLNVSPGTSFHCREPGWFRVCHANMDDETMEVALGRIHDFVRQHQQRRVKAERWAANRQLRLSLPHHHHLSPAHLSSPLALLSPQSPMVRATS

SEQ ID NO: 709 - DNA, 1584 bp, Oryza sativa
  misc_feature (483)..(483): n = any nucleotide
atggataaggcctacattgccgtcttctccattgccatcctcttcttgctcgtcgactacttccgctgtcgccgccgccgcggcagcggcagcaacaatggcgaaaacaaggggatgttgcagctgcctccgagccctccagccatcccgttcttcggccacctccacctcatcgacaagccgttgcacgccgcgctgtcccgcctcgccgagcgccacggcccggtgttctcgctgcgcctcggctcgcgcaacgccgtcgtggtgtcgtcgccggagtgcgccagggagtgcttcacggacaacgatgtgtgcttcgccaaccgcccgcagttcccctcgcagatgcccgcgacgttctacggcgccgggttcggcttcgccaactacggcgcgcactggcgcaacctccgccgcatcgccaccgtgcacctcctctccgcgcaccgcgtcaggggcatggccggcgtcgtctccggcganatccgccccatggtgcagaggatgtaccgcgccgccgccgccgccggcgtcggcgttgcgcgcgtccagctgaagcggaggctgttcgagctctcgctcagcgtcctcatggaagccatagcgcagaccaagacgacgcggccagaggcggacgacgcggacacggacatgtccgtggaggcccaggagttcaagaatgtcctcgacgagctcaacccgcttctcggcgcggccaacctgtgggattacttgccggcgctccgggtgttcgacgtgctcggcgtgaagaggaagatcgcgacgctggccaacaggagggacgcgttcgtgcgccggctgatcgacgcggagcggcagaggatggacaacggtgtcgacggcggcgatgatggcgagaagaagagcgtgatctccgtgctgcttagtctgcaaaagactgagccagaggtctacaaggatatagtgatcgtgaatctttgtgcggcattatttgctgctggaacagagactacagcaatgacaatagaatgggcaatgtcgcttctgctgaatcatcccaagatactcaagaaagcaaaggcagaaatagacgcatccgtcgggaactctcgcctgatcaatggagacgacatgcctcatcttagctatctccagtgcatcatcaacgagacgcttcgtctataccctgtagcaccactgttgatccctcacgaatcatccgcagattgtaaggttaatggctatcacattccaagtggaacgatgctgcttgtcaatgtgatcgccatccaaagagatccaatggtttggaaagagccaaatgagtttaagccagagaggttcgaaaacggcgagtccgagggattgttcatgataccgtttgggatggggagacggaagtgtccgggagagacgatggctttgcagacaattgggttggttttgggggctctgatccagtgcttcgattgggacagagtcgatggcgccgaggttgatatgacgcaaggcagtggactgaccaaccctagggctgtcccgttggaggccatgtgcaaaccacgcgaagctatgtctgatgtttttcgggaactcttgtga

SEQ ID NO: 710 - protein, 527 aa, Oryza sativa
  misc_feature (161)..(161): Xaa = any naturally occuring amino acid
MDKAYIAVFSIAILFLLVDYFRCRRRRGSGSNNGENKGMLQLPPSPPAIPFFGHLHLIDKPLHAALSRLAERHGPVFSLRLGSRNAVVVSSPECARECFTDNDVCFANRPQFPSQMPATFYGAGFGFANYGAHWRNLRRIATVHLLSAHRVRGMAGVVSGXIRPMVQRMYRAAAAAGVGVARVQLKRRLFELSLSVLMEAIAQTKTTRPEADDADTDMSVEAQEFKNVLDELNPLLGAANLWDYLPALRVFDVLGVKRKIATLANRRDAFVRRLIDAERQRMDNGVDGGDDGEKKSVISVLLSLQKTEPEVYKDIVIVNLCAALFAAGTETTAMTIEWAMSLLLNHPKILKKAKAEIDASVGNSRLINGDDMPHLSYLQCIINETLRLYPVAPLLIPHESSADCKVNGYHIPSGTMLLVNVIAIQRDPMVWKEPNEFKPERFENGESEGLFMIPFGMGRRKCPGETMALQTIGLVLGALIQCFDWDRVDGAEVDMTQGSGLTNPRAVPLEAMCKPREAMSDVFRELL

SEQ ID NO: 711 - DNA, 2403 bp, Oryza sativa
atgatatctggatatgagttcacagcccttccagataaacggacgcccggacgaaacgaaagacgacgagtcgaggaccgtcagcagccgcagaaacggcgagagacgcccccaagccaaacagcaaagccactgcagcttccatatccccggctcttccgcacacacaactcctccacctccatcgggagcaaaccgctcgagcaaccaccactcgttacagctacacatcgatctcccctctgcttcgccgttccgatggagtgcgagaacgggcacgtcgccgccgccgccaacggcagcagcctgtgcgtggctaagccgcgtgccgacccgctcaactgggggaaggcggcggaggagctgtccgggagccatctggacgcggtgaagcgcatggtggaggagtaccgcaggcccgtggtgacgatcgagggcgccagcctgaccatcgcgcaggtcgcggcggtggcctccgccggcgccgccagggtggagctcgacgagtccgcccgcggccgcgtcaaggccagcagcgactgggtcatgaacagcatgatgaacggcaccgacagctacggcgtcaccaccggcttcggcgccacctcccaccggaggaccaaggagggcggcgcgctccagcgagagcttatccggtttcttaatgccggggcgttcggcaacggcgacgacggccacgtgctgccggccgcggcgacgcgggcagccatgctcgtccgcatcaacactctgctccaggggtactctggcatccggttcgagatcctcgagacgatcgccacgctgcttaacgccaacgtgacgccgtgcttgccgctccggggcacgatcaccgcgtccggcgacctcgtcccgctctcctacatcgcgggactcgtcaccggccgaccaaactctgtggcggtgacgcccgatggcaggaaggtggatgccgcggaggcgttcaagatcgccggcatccagcacggcttcttcgagctccagcccaaggaaggcctcgccatggtgaacggcacggccgtcggctccgggctcgcctcgatggtgctctttgaggcgaacgtccttggcgtgctcgcggaggtcctctccgcggtgttctgcgaggtcatgaacggcaagccggagtacaccgaccacctgacgcacaagcttaagcaccacccgggacagattgaggcagccgccattatggagcacatcttggaggggagctcctacatgatgctggcgaagaagctcggcgagctcgacccgctgatgaagcccaagcaagacaggtacgcgctccgcacgtcgccgcaatggctcggcccccagattgaggtcatccgtgccgccaccaagtcgatcgagcgcgagatcaactccgtcaacgacaacccgctcattgacgtctcccgtggcaaggcgctccacggcggcaacttccagggcacacccatcggcgtgtccatggacaacaccaggctcgccattgccgcgatcggtaagctcatgttcgcgcagttctctgagctcgtgaacgatttctacaacaacggcctgccgtccaacctgtccggtgggcgcaacccgagcttggactacggcttcaagggtgccgagatcgccatggcatcgtactgctctgagctccagttcttggccaaccctgtgaccaaccatgtccagagcgcggagcagcacaaccaagacgtcaactctctcggcctcatctcgtccaggaagacggccgaggccatcgacgtgctcaagctcatgtcctcgacgttcttgatcgcgctatgccaggccatcgacctgcgccacctcgaagagaacgtcaggagcgccgtcaagggctgcgtgacgacggtggcgaggaagaccctgagcaccagcgccaccggcgacctccacaaggcccggttctgcgagaaggacctgctccaggcgatcgaccgcgaggccgtgttcgcgtacgcggacgacccctgcagcgccaactacccgctgatgcagaagatgcgcgccgtcctcatcgagcacgcgctggccaacggcgaggcggagcgcaacgtcgacacctcggtgttcgccaaggtcgcgacgttcgaggaggagctccgcgtggcgctgcccagggaggtggaggctgcccgtgcggccgtggagaacggcaccgccgcaaaggcgaacaggatcaccgagtgcaggtcgtacccgctctaccggttcgtccgcgaggagctcgggacagagtacttgaccggggagaagacgcggtcgcccggcgaggaggtgaacaaggtgttcgtcgccatgaaccagggcaagcacatcgacgcactgctcgagtgcctcaaggagtggaacggcgagcctctgcccatctgctga

SEQ ID NO: 712 - protein, 800 aa, Oryza sativa
MISGYEFTALPDKRTPGRNERRRVEDRQQPQKRRETPPSQTAKPLQLPYPRLFRTHNSSTSIGSKPLEQPPLVTATHRSPLCFAVPMECENGHVAAAANGSSLCVAKPRADPLNWGKAAEELSGSHLDAVKRMVEEYRRPVVTIEGASLTIAQVAAVASAGAARVELDESARGRVKASSDWVMNSMMNGTDSYGVTTGFGATSHRRTKEGGALQRELIRFLNAGAFGNGDDGHVLPAAATRAAMLVRINTLLQGYSGIRFEILETIATLLNANVTPCLPLRGTITASGDLVPLSYIAGLVTGRPNSVAVTPDGRKVDAAEAFKIAGIQHGFFELQPKEGLAMVNGTAVGSGLASMVLFEANVLGVLAEVLSAVFCEVMNGKPEYTDHLTHKLKHHPGQIEAAAIMEHILEGSSYMMLAKKLGELDPLMKPKQDRYALRTSPQWLGPQIEVIRAATKSIEREINSVNDNPLIDVSRGKALHGGNFQGTPIGVSMDNTRLAIAAIGKLMFAQFSELVNDFYNNGLPSNLSGGRNPSLDYGFKGAEIAMASYCSELQFLANPVTNHVQSAEQHNQDVNSLGLISSRKTAEAIDVLKLMSSTFLIALCQAIDLRHLEENVRSAVKGCVTTVARKTLSTSATGDLHKARFCEKDLLQAIDREAVFAYADDPCSANYPLMQKMRAVLIEHALANGEAERNVDTSVFAKVATFEEELRVALPREVEAARAAVENGTAAKANRITECRSYPLYRFVREELGTEYLTGEKTRSPGEEVNKVFVAMNQGKHIDALLECLKEWNGEPLPIC

SEQ ID NO: 713 - DNA, 825 bp, Oryza sativa
  misc_feature (301)..(301): n = any nucleotide
  misc_feature (495)..(495): n = any nucleotide
atggccgggatcgtggtggtgttcgacttcgacaagacgatcatcgacgtcgacagcgacaactgggtcgtggacgggctcggcgcgacggaggagttcgagcggctgctgcccaccatgccgtggaacaccctcatggacaccatgatgggcgagctccacgcgagcggcaagtcgctcgccgacgtcgcgggcgtgctcaggtcggcgccgctcgacccgcgcgtcgtcgccgccatcaaggcctgctacggcctgggctgcgacctccggatcctcagcgacgccaaccgcttcttcntcgacaccatcctcgaccaccacggcctcacgggttacttctccgagatcaacaccaacccgagcgccgtcgacgccgccaccggccgcctccgcatcgcgccgtaccacgacttccacgccggcccgcacgggtgcggcctcgggatctgcccgcccaacatgtgcaagggccaggtgctcgaccgcatccgngcctccgccggcgccgccggcaagagggtcatctacctcggtgacggccgcggcgactactgcccgtcgctccgcctcggccgcgacgacttcatgatgccacgcaggggcttccccgtgtgggagctcatctgcgaggacccgtcgctgctccacgcggaggtgcactcgtgggccgacggcgccgagatggaggagacgctgctgcggctggtcggcagggtgctcctcgaggagaggaacctgccgccgctcgactgcaagctcgagtcgttgccggccgtcgccgtgcaggacggcatgcccatgacgctccggatcaagaactga

SEQ ID NO: 714 - protein, 274 aa, Oryza sativa
MAGIVVVFDFDKTIIDVDSDNWVVDGLGATEEFERLLPTMPWNTLMDTMMGELHASGKSLADVAGVLRSAPLDPRVVAAIKACYGLGCDLRILSDANRFFLDTILDHHGLTGYFSEINTNPSAVDAATGRLRIAPYHDFHAGPHGCGLGICPPNMCKGQVLDRIRASAGAAGKRVIYLGDGRGDYCPSLRLGRDDFMMPRRGFPVWELICEDPSLLHAEVHSWADGAEMEETLLRLVGRVLLEERNLPPLDCKLESLPAVAVQDGMPMTLRIKN

SEQ ID NO: 715 - DNA, 333 bp, Oryza sativa
atgaagggacggcaaggccagcgcgtgaggctgtacgtccgcggcaccatcctcggctacaagaggtcgaagtcgaaccagtacgagaacacgtcgctgctgcagatcgagggggtgaacaccaaggaggaggttgggtggtacgccgggaagcgcatcgcctacgtctacaaggccaagacgaagagcaacgactccaccatccgctgcatctggggcaaggtcacccgcccgcacggcaactccggtgtcgtccgcgccaagttccggtccaacctcccgcccacctccatggtgaatctcgctctcaccgtcgtctgcgccatcatttga

SEQ ID NO: 716 - protein, 110 aa, Oryza sativa
MKGRQGQRVRLYVRGTILGYKRSKSNQYENTSLLQIEGVNTKEEVGWYAGKRIAYVYKAKTKSNDSTIRCIWGKVTRPHGNSGVVRAKFRSNLPPTSMVNLALTVVCAII

SEQ ID NO: 717 - DNA, 1086 bp, Oryza sativa
atggccgcggcggccgacgaggaggcgtgcatgtacgcgctgcagctggcgtcgtcgtcgatcctgccgatgacgctcaagaacgccatcgagctgggcctgctcgagacgctgcagtccgccgccgtcgccggaggaagggggaaagcggcgctgctgacgccggcggaggtggccgacaagctgccgtccaaggcgaacccggcggcggccgacatggtggaccgcatgctccgcctgctcgcctcctacaacgtcgtcaggtgcgagatggaggagggcgccgacggcaagctctcccgccgctacgccgccgcgccggtgtgcaagtggctgacgcccaacgaggacggcgtctccatggccgccctcgccctcatgaaccaggacaaggtcctcatggagagctggtactaccttaaggacgcagtcctggacggcggcatcccgttcaacaaggcgtacgggatgacggcgttcgagtaccacggcacggacgcccgcttcaaccgcgtcttcaacgagggcatgaagaaccactccgtcatcatcaccaagaagctgctcgacctctacaccggcttcgacgccgcctccaccgtcgtcgacgtcggcggcggcgtgggcgccactgtggccgccgtcgtctcccgccacccgcacatccgggggatcaactacgacctcccccacgtcatctccgaggcgccgccgttccccggggtggagcacgtcggcggcgacatgttcgcctccgtgccccgcggcggcgacgccatcctgatgaagtggatcctccacgactggagcgacgagcactgcgcgcggctgctcaagaactgctacgacgcgctgccggagcacgggaaggtggtggtggtggagtgcgtgctgccggagagctccgacgcgacggcgagggagcagggggtgttccacgtcgacatgatcatgctcgcccacaaccccggcggcaaggagaggtacgagagggagttcagggagctcgcccgcgccgccggattcaccggcttcaaggccacctacatctacgccaacgcctgggccatcgagttcaccaagtag

SEQ ID NO: 718 - protein, 361 aa, Oryza sativa
MAAAADEEACMYALQLASSSILPMTLKNAIELGLLETLQSAAVAGGRGKAALLTPAEVADKLPSKANPAAADMVDRMLRLLASYNVVRCEMEEGADGKLSRRYAAAPVCKWLTPNEDGVSMAALALMNQDKVLMESWYYLKDAVLDGGIPFNKAYGMTAFEYHGTDARFNRVFNEGMKNHSVIITKKLLDLYTGFDAASTVVDVGGGVGATVAAVVSRHPHIRGINYDLPHVISEAPPFPGVEHVGGDMFASVPRGGDAILMKWILHDWSDEHCARLLKNCYDALPEHGKVVVVECVLPESSDATAREQGVFHVDMIMLAHNPGGKERYEREFRELARAAGFTGFKATYIYANAWAIEFTK

SEQ ID NO: 719 - DNA, 828 bp, Oryza sativa
atgttggccatattccagaagcaggtggcgcacgcgccggcggagctgaacagcccgcggagcagcgcggcgaagcccaagaaccccgacgagatcctcagggacttccacgccctccaccccatcgaggccttctccacctccttcggcggcggcgccgccttcgcctgcgtcgccggccacgcccgcaatggcctctctggctacgagaggatgttctgtgggctggatgacatctactgcgtgttcatggggaggctggacaacctgagcagcctgatccggcagtacgggctgtgcagccgctccaccaacgaggcgctgctcgtcatcgaggcctaccgcaccctccgcgaccgcggcccctaccccgccgaccaggtcgtcaaggatctctccggctccttcgccttcgtcgtcttcgacaacaagtccggcgccgtcttcgccgccctgactggttttctgaatcgaattgatgaatttgtgcttcaaattgaacttcctagtacggatggggaggtgccgttgtattgggggatcgcggcggatgggtcggtggtgatctgcgacgagagggagatcgtgaagggagggtgcggcaagtcgtacgcgccgttcccggtggggtgcatgttccacagcgagggggggctcaagagcttcgagcacccgatgaaccggctgaaggcgatgccgcgggtggacagcgagggcgtcatgtgcggcgccaccttcaaggtcgacaccttcaccaagatcaactccatgccccgcgtcggcagcgccaccaactgggccgccacctgggacgacgctgccgcctga

SEQ ID NO: 720 - protein, 275 aa, Oryza sativa
MLAIFQKQVAHAPAELNSPRSSAAKPKNPDEILRDFHALHPIEAFSTSFGGGAAFACVAGHARNGLSGYERMFCGLDDIYCVFMGRLDNLSSLIRQYGLCSRSTNEALLVIEAYRTLRDRGPYPADQVVKDLSGSFAFVVFDNKSGAVFAALTGFLNRIDEFVLQIELPSTDGEVPLYWGIAADGSVVICDEREIVKGGCGKSYAPFPVGCMFHSEGGLKSFEHPMNRLKAMPRVDSEGVMCGATFKVDTFTKINSMPRVGSATNWAATWDDAAA

SEQ ID NO: 721 - DNA, 774 bp, Oryza sativa
atggggaaggctccgtgctgcgagaagatggggctcaagaagggtccatggacgccggaggaggacaaggtcctcgtcgcccacatccagcgccacggccacggcaactggcgcgccctgcccaagcaagccgggctgctgcgttgcggcaagagctgccggctccggtggatcaactacctgcggccggacatcaagcggggcaacttctccaaggaggaggaggacaccatcatccatctccacgagctgcttggcaacaggtggtccgcaattgccgccaggttccccgggaggacggacaacgggatcaagaacgtgtggcacaacccacctcaagaagcgcctcgatgcgccggctcagggcggtcatgtcgcggcgagcggcggcaagaagcacaagaagccgaagagcgcgaagaagccagccgccgccgacgccggccgccggcgtcgcccgagcggtccgcctcgtcgtcggtgacggagtcctcgatggcctcgtcggtggcggaggagcacggcaacgccgggatcagctcggcgtccgcgtccgtgtgcgccaaggaggagagctccttcacctcggcttccgaggagttccagatcgacgacagcttctggtcggagacgctgtcgatgccgctggacgggtacgacgtgtccatggagcccggcgacgcgttcgtcgcgccgccatccgccgacgacatggactactggctcggagtgttcatggagtccggcgaagcgcaagacttgccgcagatctag

SEQ ID NO: 722 - protein, 257 aa, Oryza sativa
MGKAPCCEKMGLKKGPWTPEEDKVLVAHIQRHGHGNWRALPKQAGLLRCGKSCRLRWINYLRPDIKRGNFSKEEEDTIIHLHELLGNRWSAIAARFPGRTDNGIKNVWHNPPQEAPRCAGSGRSCRGERRQEAQEAEEREEASRRRRRPPASPERSASSSVTESSMASSVAEEHGNAGISSASASVCAKEESSFTSASEEFQIDDSFWSETLSMPLDGYDVSMEPGDAFVAPPSADDMDYWLGVFMESGEAQDLPQI

SEQ ID NO: 723 - DNA, 633 bp, Oryza sativa
  misc_feature (444)..(444): n = any nucleotide
atggccaagctgatcctcgccaccttcgccgtcgtgttcctggcgctcgccgccacctccctcgcaggcgaccccgacatgctccaggacgtctgcgtcgccgattacaagtccctccgaggcccgctgcggctgaacgggatcccgtgcaagaggctggagaacgtgacggcgaacgacttcttcttcgacgggctgacgaacgccgggaacacgacgaacgcggtggggtcgctggtgacggcggcgagcgtggagaggctgccggggctgaacacgatgggggtgtccatggcgcggatcgactacgcgccgtgggggctcagcccgccgcacacccacccgcgcgccaccgagatcatgttcgtcgccgagggcaccctcgacgtcggcttcgtcaccaccgccaacaagctcttcacccgcaccgtcagcaaggggganaggaacagcggcaacacgtcggcgctcgccatcgccgccttcaacagccagctccccgggacgcagtccatcgccgacacgctcttcggcgccgcgccgccgctgccgtcggacacgctggccagggcgttccaggtcgacggcggcatggtcgagtccatcaagtccaagttcccgcccaaatactag

SEQ ID NO: 724 - protein, 210 aa, Oryza sativa
  misc_feature (148)..(148): Xaa = any naturally occuring amino acid
MAKLILATFAVVFLALAATSLAGDPDMLQDVCVADYKSLRGPLRLNGIPCKRLENVTANDFFFDGLTNAGNTTNAVGSLVTAASVERLPGLNTMGVSMARIDYAPWGLSPPHTHPRATEIMFVAEGTLDVGFVTTANKLFTRTVSKGXRNSGNTSALAIAAFNSQLPGTQSIADTLFGAAPPLPSDTLARAFQVDGGMVESIKSKFPPKY

SEQ ID NO: 725 - DNA, 744 bp, Oryza sativa
  misc_feature (240)..(240): n = any nucleotide
  misc_feature (456)..(456): n = any nucleotide
  misc_feature (510)..(510): n = any nucleotide
atggcggtggaggcggttcttgaggcgtcgagaagtagtagtgaggaggaggcggaggtgatcgtcacgcacggcggcggcggcggcggcggaggaggaggaggacaggtggaggggtgggggaagcggaagcggtcgcggcggcggcgaccgcagctgccgccctccgaggaggagtacctcgcgctctgcctcctcatgctggcgcgcgggcgacgcgacggcgacgacgtggcggcntcggcgtcggcggcggcggcggcggtggagcaccggtgctccgtctgcggcaaggcgttcgcgtcctaccaggctctcggcggccacaaggccagccaccggaagccgccgccgcccgccatggtcgacgacgacgaggtggtggtggagacgaaaccggcggctatcgcgacgccgtcctcgtcggcgtcgggcgtctccggcggcggcggcggnagggcgcacgagtgcaacgtgtgcggcaaggcgttcccgacggggcaagcgctnggcggccacaagcgatgccactacgacggcacgatcggcagcgccgccggcgccggcgcgtccaagccggcggcgaagacgaccgtggcggtggcggcgagccggggcttcgacctcaacctgccggcgctgccggacgtcgccgccgccgccgaccagcggtgcgcggcggaggacgacgaggtgctcagccctctcgccttcaagaagcccaggctcatgatcccggcatag

SEQ ID NO: 726 - protein, 247 aa, Oryza sativa; identical to SEQ ID NO: 532

SEQ ID NO: 727 - DNA, 2079 bp, Oryza sativa
  misc_feature (267)..(267): n = any nucleotide
  misc_feature (375)..(375): n = any nucleotide
  misc_feature (625)..(625): n = any nucleotide
  misc_feature (636)..(636): n = any nucleotide
  misc_feature (648)..(648): n = any nucleotide
  misc_feature (696)..(696): n = any nucleotide
  misc_feature (1772)..(1772): n = any nucleotide
  misc_feature (1783)..(1783): n = any nucleotide
  misc_feature (1996)..(1996): n = any nucleotide
atggagtgcgagactggctacgtcgccgcggccgccgatggtggtctctgcatggaggtgccccgcgccgacccgctcaactgggggaaggcggcggaggagatggccgggagccacctcgacgaggtgaagaggatggtggcggagtaccggcagcccgtggtgcggatcgagggcgccagcctgaggatcgcgcaggtggcggcggttgccggcgccggcgacggcgaggccgccatggtcgagctcgacgagtcggcgcgggancgcgtcaaggccagcagcgactgggtgatgaacagcatggcgaacggcaccgacagctacggcgtcaccaccgggttcggcgccacgtcgcaccggcggaccaagganggcggcgcgctgcagcgggagctcatcaggttcctcaacgccggcgcctttggaaccggcgccgacggccaagttcttcccgcgggtgccacgcgcgcggcgatgctcgtccggatcaacaccctgctgcaaggctactccggcatccggttcgagatcctcgaggcggtcgccaagctgctcaacgccaagttaagccgtgcctgccgctccgggggcacgatcaccgcttcgggggaacttgtcccgntttcctacatngccgggctcgtnaccggccgggagaactccgtcgcggtggcgcccgacggcaggaaggtnaacgccgccgaggcgttcaagatcgccggcatccagggcggcttcttcgagctgcagcccaaggaaggcctcgccatggtgaacgggacggccctgggctccggcttggcttcaaccgtgctgttcgaggccaacgtgctctccgccgtgttctgcgaggtgatgaacggcaagccggagtacaccgaccacctcacccacaagctgaagcaccacccggggcagatcgaggcggccgccatcatggagcacatcttggaaggcagctcgtacatgaaggaggcgaagaggctcggcgagctcgacccgctgatgaagccgaagcaggacaggtacgcgctccggacgtcgccgcagtggctcggcccccagatcgaggtcatccgcgccgccaccaagtcgatcgagcgcgagatcaactccgtcaacgacaacccgctcatcgacgtctcccgcgggaaggcgctgcacggcggcaacttccagggcacccccatcggcgtgtccatggacaacacccgcctcgccatcgccgccatcgggaagctcatgttcgcgcagttctccgagctggtgaacgacttctacaacaacggcctgccctccaacctctccggcggccgcaacccgagcttggactacggcttcaagggcgccgagatcgccatggcgtcctactgctccgagctgcagttcttgggcaacccggtgaccaaccacgtccagagcgccgagcagcacaaccaggacgtgaactcgctgggcctcatctcctccaggaagacggcggaggccatcgacatcctcaagctcatgtcctccaccttcctcgtcgcgctctgccaggcgatcgacctgcgccacatcgaggagaacgtcaagggcgccgtcaagacctgcgtcatgacggtcgccaagaagacgctgagcaccaactccaccggcggcctccacgtcgcccgcttctgcgagaaggacctgctcagcgagatcgaccgggaggccgtgttcgcgtacgccgacgacccgtgcagcgccaactacccgctgatgaagaagctccgcagcacctccgngctcgccaagntcgcgcggttcgaggaggagctccgcgcggcgctgccccgggccgtcgaggccgcgcgcgccgccgtggagagcggcacggcggcggcgcccaacaggatcgccgagtgccgctcgtacccgctctaccggttcgtgcgcgaggagctcggcaccgcctacctcaccggcgagaagacgcggtcgcccggcgaggagctcaacaaggtgctcntcgcgatcaaccagggcaagcacatcgacccgctgctcgagtgcctcaaggagtggaacggcgcgccactgccaatctgctga

SEQ ID NO: 728 - protein, 692 aa, Oryza sativa
MECETGYVAAAADGGLCMEVPRADPLNWGKAAEEMAGSHLDEVKRMVAEYRQPVVRIEGASLRIAQVAAVAGAGDGEAAMVELDESARDRVKASSDWVMNSMANGTDSYGVTTGFGATSHRRTKDGGALQRELIRFLNAGAFGTGADGQVLPAGATRAAMLVRINTLLQGYSGIRFEILEAVAKLLNAKLSRACRSGGTITASGELVPLSYIAGLVTGRENSVAVAPDGRKVNAAEAFKIAGIQGGFFELQPKEGLAMVNGTALGSGLASTVLFEANVLSAVFCEVMNGKPEYTDHLTHKLKHHPGQIEAAAIMEHILEGSSYMKEAKRLGELDPLMKPKQDRYALRTSPQWLGPQIEVIRAATKSIEREINSVNDNPLIDVSRGKALHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISSRKTAEAIDILKLMSSTFLVALCQAIDLRHIEENVKGAVKTCVMTVAKKTLSTNSTGGLHVARFCEKDLLSEIDREAVFAYADDPCSANYPLMKKLRSTSALAKLARFEEELRAALPRAVEAARAAVESGTAAAPNRIAECRSYPLYRFVREELGTAYLTGEKTRSPGEELNKVLLAINQGKHIDPLLECLKEWNGAPLPIC

SEQ ID NO: 729 - DNA, 1680 bp, Oryza sativa
  misc_feature (445)..(445): n = any nucleotide
atggccgaagacgccgcggcggccgccatggccgcggcctccctctccgacgacctggagcccgccaccgaccgcacccgcatccgatccatcctggccgacggcgccgcgcgcgccggcgagcgcgtcgtcgtgggcgggtgggtcaagaccgggcgggagcaggggaaaggcaccttcgccttcctcgagctcaacgatggctcctgcgcctccaacctgcaggtcctcgtcgacgccgccgtccacccgctcgcgccgctcaccgccacgggcacgtccgtgctcgtcgagggcgagctcaagaagccgccggagggcgccaagcagcgcgtcgagctccgcgtcgaccgcgtcatcgaggtcggcgaggtcgaccccgccgcctacccgctgcccaagaccaagctcacgctcgagaatctcagggacgtcgtccatctcngctcccgcaccaacacgattggtgctgttgcgcgtattagacaccagctagcctgtgcaacacacaggttttttgatgagaatggttttctttatgtgcacacaccaataataactacaagtgattgtgagggtgctggtgagatgtttcaagtgacgactttgttcagccatgctgaaaaggtggagaaggaattgaaagagaaccctgcaccatcagagtctgatattgaggcagctagagttgttgtcaaggaaaaaggtgatgcggttgcacagcttaaagctgcaaaagctagcaaacaagaaatcacagctgctgttgctgagcttaacaaggcaaaagaaaatgtctcaaggctggaggaaagatctaagttgaagcccggaattccgtacagagatgatgggacagtagcttatgagaatgacttcttcaaacgccaggcttttctgactgtgtctggacagcttcaagttgagacctatgcatgtgctcttagcagtgtttatacctttggaccaacattccgtgcagaaaactcccatacatcacgacatttggcagagttttggatggttgaaccagaaatcgcatttgctaacttgcaggatgatatgaactgtgcagaaagatatgtacagtacctttgcaagtggcttcttgagcattgccgggaagacatggaattcatggtgaaaaattacgataagactgcaattgagcgtctggagcttgtttcctcgacaccttttcagcgcatttcatatacaaaagctgttgagctattgaaaaatgtcactgataagaaattcgaaaacaaggttgaatggggaattgatttagcttcagagcatgaaaggtatttaaccgaggtgatatttaagaagccggtgattgtttataactatcccaaagaaataaaggcattttatatgagactcaatgatgatcagaagactgtagctgctatggatgttcttgtgcccaaggttggtgagttggttggtggaagccaaagggaggaacgtctggaccttctcaaaacaaggatacaagacgccgggttgcctttggagccatatgaatggtacttggacctccgccgctttggatctgtcaagcacagtggttttggtttgggttttgaaagaatgattctttttgccactggtttggagaacatcagagatgtcatccccttccctagatacccagggagggctgatctctaa

SEQ ID NO: 730 - protein, 559 aa, Oryza sativa
MAEDAAAAAMAAASLSDDLEPATDRTRIRSILADGAARAGERVVVGGWVKTGREQGKGTFAFLELNDGSCASNLQVLVDAAVHPLAPLTATGTSVLVEGELKKPPEGAKQRVELRVDRVIEVGEVDPAAYPLPKTKLTLENLRDVVHLRSRTNTIGAVARIRHQLACATHRFFDENGFLYVHTPIITTSDCEGAGEMFQVTTLFSHAEKVEKELKENPAPSESDIEAARVVVKEKGDAVAQLKAAKASKQEITAAVAELNKAKENVSRLEERSKLKPGIPYRDDGTVAYENDFFKRQAFLTVSGQLQVETYACALSSVYTFGPTFRAENSHTSRHLAEFWMVEPEIAFANLQDDMNCAERYVQYLCKWLLEHCREDMEFMVKNYDKTAIERLELVSSTPFQRISYTKAVELLKNVTDKKFENKVEWGIDLASEHERYLTEVIFKKPVIVYNYPKEIKAFYMRLNDDQKTVAAMDVLVPKVGELVGGSQREERLDLLKTRIQDAGLPLEPYEWYLDLRRFGSVKHSGFGLGFERMILFATGLENIRDVIPFPRYPGRADL

SEQ ID NO: 731 - DNA, 264 bp, Oryza sativa
atggtgctctccaacgacatcgacctgctgaacccgcccgcggagctggagaagctcaagcacaagaagaagcgcctcgtccagtcccccaactccttcttcatggatgtcaagtgccagggctgcttcagcatgatcactactgtgttcagccactcccagacagtggtggtctgcccgggctgccaaaccgtgctttgccagcctacaggtggaaaggccaggctaacggaggggtgctccttccgccgcaagaatgattaa

SEQ ID NO: 732 - protein, 87 aa, Oryza sativa
MVLSNDIDLLNPPAELEKLKHKKKRLVQSPNSFFMDVKCQGCFSMITTVFSHSQTVVVCPGCQTVLCQPTGGKARLTEGCSFRRKND

SEQ ID NO: 733 - DNA, 891 bp, Oryza sativa
  misc_feature (261)..(261): n = any nucleotide
  misc_feature (327)..(327): n = any nucleotide
  misc_feature (381)..(381): n = any nucleotide
atggagacctcgtgcttccttacctccaatgcctcgccggtgaagagcatggtgatgccgtcgccggccggcgtcgtgaaggccaggccgcacgtgctcttcggcggccggcgagcggcgagctcgtcggtgaccacctgctgcagctacaacggcgagggcgcggcgccggcgatcgacccggactggcggtcgttcagggcgcagctctacttcaacgagcagtacgcgaagagcgtgaacccggcggtggcggcggtnagggcgacggcgacgacgccggagccggtgaagatcggcgacaagtgggcgcacccgctagtgganccggagaaggggtgcctgctgatcgcgacggagaagctggacgggtcgcacatnttcgagcgcacggtggtcctcctcctgtccgccggcgtgctgggccccgtgggcgtgatcctgaaccggccgtcgctgatgtcgatcaaggaggcgcaggcggtgttcgcggagacggacatcgcgggggcgttctcggggcggccgctcttcttcggtggcccgctggaggagtgcttcttcctgctggggccgcgggcggcggcggcgggggacgtggtggggaggacggggctgttcgacgaagtgatgcccggggtgcactacgggacgcgggagagcgtggggtgcgcggcggagctggtgaagcgcggcgtggtcggggtgagggacttccgcttcttcgacggcttctgcgggtgggagagggagcagctgcgcgacgaggtgcgcgcgggcttgtggcgcgtggcggcgtgcagccccgccgtgctgggcctcgccaccgtcgtcaagggcggactctgggaggaggtgcagggcctcgtcggagagaggagggtgtggtga

SEQ ID NO: 734 - protein, 296 aa, Oryza sativa
METSCFLTSNASPVKSMVMPSPAGVVKARPHVLFGGRRAASSSVTTCCSYNGEGAAPAIDPDWRSFRAQLYFNEQYAKSVNPAVAAVRATATTPEPVKIGDKWAHPLVDPEKGCLLIATEKLDGSHIFERTVVLLLSAGVLGPVGVILNRPSLMSIKEAQAVFAETDIAGAFSGRPLFFGGPLEECFFLLGPRAAAAGDVVGRTGLFDEVMPGVHYGTRESVGCAAELVKRGVVGVRDFRFFDGFCGWEREQLRDEVRAGLWRVAACSPAVLGLATVVKGGLWEEVQGLVGERRVW

SEQ ID NO: 735 - DNA, 768 bp, Oryza sativa
atggggagggaggagaggttcccggtgtgggaggcggcactgctcgccggcgtcgcggccgcctttgccacgggtctcgtcggcgtctacctctccatgcctcattcggactacagcttcctcaagctgcccaagaacctccaggagctccaaatcctcacggatcatctcgaggactacacgagcgactacaccgtgcaggtgctggtgggctattgtgccgtgtacatcttcatgcagacgttcatgatcccaggaaccatattcatgtccctccttgccggagcactctttggccagcttggtggtgttgcccttgtggtctttgccgccacggctggagcttcttcatgctacttcctgtctaagctgattgggaaaccgttggtcttctcattgtggccggacaaacttgggttctttcagaagcaggttgcaaaaaggagagagaagctgttgaattacatgcttttccttagagtaactccaacattgcccaatactttcatcaatttagcgtcgccgatagtggatgtgccctaccatattttcttcctggcaacctttattggactaatcccagctgcctatgtgactgtcagggctggaatagctttgggagacttgagctcattgagtgacctatatgataaacaatcaatagcactgttgttcttgattggggttgtttcggtgacaccgacattgttgggcaagaacgagaagcaacaaggcaaagggccagaaatggtagctagcagtagctga

SEQ ID NO: 736 - protein, 255 aa, Oryza sativa
MGREERFPVWEAALLAGVAAAFATGLVGVYLSMPHSDYSFLKLPKNLQELQILTDHLEDYTSDYTVQVLVGYCAVYIFMQTFMIPGTIFMSLLAGALFGQLGGVALVVFAATAGASSCYFLSKLIGKPLVFSLWPDKLGFFQKQVAKRREKLLNYMLFLRVTPTLPNTFINLASPIVDVPYHIFFLATFIGLIPAAYVTVRAGIALGDLSSLSDLYDKQSIALLFLIGVVSVTPTLLGKNEKQQGKGPEMVASSS

SEQ ID NO: 737 - DNA, 393 bp, Oryza sativa
atggcgcgcggcgtggcggtggcggcgaagggcggcgcgggcggcaagaagaagggctccgtctcgttcgtgatcgactgctccaagcccgtggaggacaagatcatggagatcgcgtcgctggagaagttcctgcaggagcgcatcaaggtcgccggcggcaaggccgggaacctcggcgactccgtcaccgtcacgcgcgacaagaccaaggtcaccgtcacctccgacggggccttctccaagaggtatctgaagtacttgaccaagaagtacttgaagaagcacaatgtgcgggactggctacgtgttattgcggctaacaaggaccgcaatgtctatgagctcagatacttcaacattgctgagaacgagggcgaggaggaagactag

SEQ ID NO: 738 - protein, 130 aa, Oryza sativa
MARGVAVAAKGGAGGKKKGSVSFVIDCSKPVEDKIMEIASLEKFLQERIKVAGGKAGNLGDSVTVTRDKTKVTVTSDGAFSKRYLKYLTKKYLKKHNVRDWLRVIAANKDRNVYELRYFNIAENEGEEED

SEQ ID NO: 739 - DNA, 1893 bp, Oryza sativa
atgttatataacttggataaacttttggatactcgtggcacgcttttcaaactgctaaacgcctggaagcctcttctctctctaagaccccatttcttggaagctcactgcccccaaccaggcagagccatggaagacgccagcaggggagaagaagaaaattcgatgttcgagaccagccacgtcctcggcgcgctgctcgcctcctcgccgctgctggcgcgggcgtgggaccgccggaggacgccggcgaggaagccggtcgccgtgcaggcgctggcgctgcaggggttcttgaggctgtgcagatcccctgaattccaggtgctgctgaaccagatcagaggcaaggcagtagtgttcactggccactccctcggtggtgccattgctgcccttgtggcgctgcactacctttgcacatcatcgtcaagctcagcatttgcccctgctcctccggtgctttgtgtcacattcgggagcccgctgcttggcaatcaggccctgtctagggctatcctgcgtgagcggtgggccggcaacttctgccatgtggtctcacagcatgatgttgtcccaaggctcctcttctgcccactcaatgtcatccctgtgcacattgttgttggtatgcagctgcaccagttgccggtgcgcgcgcgccgtgcagccggtgtggtggccacggtcactgcccgcatggctgacaccaaccaggagtcgctgcggcagctgatccaagagcacgccggtgaggcagcaattgagcagaagcttgctgctccggaaatacccagtgggagcccataccggccttttggggcgtatgtcctgtgctctccggatggtgcggcgtgtgtcgacaatccaacagcagcggttcagatgctatatgcaacatttgctgcaaggcgtgctccagagacaggcgcggtgccacctgaggctgcacactcctgctacggtgacctcgtgctgagcatgccgcaccacttgctgctcaagaggcgccttggtgccacagtcaccgcacctgccgcgtccaactacgacgtcggcatctccattgcactggaggcatcaggtatcaccggtgaagctacagaggcagcaccggcacggcagtggctgaagacgtcgaagcgcgtgggccggagcccgagcctgaactgtgcgagcctcgcaacgcggttgggacggatcacgccgtgccgagcgcagatcgagtggtacaaggcattgttcgatgccaacaccgggtattacgacgcattcaagcagcggctatcacctaagaagttcagcaaggccaacatgtaccgcatcaagctcgcacagttctgggatggcgtcctctccatgcttgacaccagccagctcccctacgacttccaccgccgtgccaagtgggtcaacgctgcccacttctaccagctccttgttgagccacttgacattgccgactaccaccgaaacaacctacaccgcacacgcggctcttacatcacccatggccgggagagaaggtatgagctgttcgacaagtggtggaaacagaagggctgcacagatcccagcactggtgacacctctgccaccacgacagcgaggaggagcaagttcgctgggctaacgcaggacccgtgcttctgggcgagggtggaggaagcgcgcgagcagacagagagtgccaagagcgaacgcgacatgacatcgctggcgaggatgctggaggacttgcacaagtttgagcgccattccagcgagctggtggagaacaaggaggtctccattgatgtcgttgcgccacagtcgagctactccctgtgggtgaaggagtggaatgagctcaagctccgggaagaagttaggacaatattgtttcaattttga

SEQ ID NO: 740 - protein, 630 aa, Oryza sativa
MLYNLDKLLDTRGTLFKLLNAWKPLLSLRPHFLEAHCPQPGRAMEDASRGEEENSMFETSHVLGALLASSPLLARAWDRRRTPARKPVAVQALALQGFLRLCRSPEFQVLLNQIRGKAVVFTGHSLGGAIAALVALHYLCTSSSSSAFAPAPPVLCVTFGSPLLGNQALSRAILRERWAGNFCHVVSQHDVVPRLLFCPLNVIPVHIVVGMQLHQLPVRARRAAGVVATVTARMADTNQESLRQLIQEHAGEAAIEQKLAAPEIPSGSPYRPFGAYVLCSPDGAACVDNPTAAVQMLYATFAARRAPETGAVPPEAAHSCYGDLVLSMPHHLLLKRRLGATVTAPAASNYDVGISIALEASGITGEATEAAPARQWLKTSKRVGRSPSLNCASLATRLGRITPCRAQIEWYKALFDANTGYYDAFKQRLSPKKFSKANMYRIKLAQFWDGVLSMLDTSQLPYDFHRRAKWVNAAHFYQLLVEPLDIADYHRNNLHRTRGSYITHGRERRYELFDKWWKQKGCTDPSTGDTSATTTARRSKFAGLTQDPCFWARVEEAREQTESAKSERDMTSLARMLEDLHKFERHSSELVENKEVSIDVVAPQSSYSLWVKEWNELKLREEVRTILFQF

SEQ ID NO: 741 - DNA, 1071 bp, Oryza sativa
  misc_feature (131)..(131): n = any nucleotide
  misc_feature (217)..(217): n = any nucleotide
  misc_feature (222)..(222): n = any nucleotide
atggcgtccaggactagtgctactgccggcatgctgctgctcgccgccgcggctgcgctggtgtgcagctcggcggcggcgaggatgccgccgttggcgaaggggttgtcgttgggctactacgacgcganttgcccgcaggcggaggccgtcgtgttcgagttcctgcaggacgccatcgccaaggacgtcggcctcgccgcggcgctgatccggntccanttccacgactgcttcgtccagggctgcgacgcctccatcctgctcgacagcacacccaccgagaagagcgagaagttggcgccgccgaacaagaccctccgcaagtcggcgttcgacgccatcgacgatctccgcgacctgctcgacagggaatgcggcgacaccgtcgtgtcctgctccgacatcgtcaccctcgccgcccgcgactccgtcctcctcgccggtggcccgtggtacgatgttcccctcggccgccacgacggctccagtttcgcgtctgaggacgccgtcctgagcgcgctcccgtcgccggactccaacgtcaccacgctcctcgaagcgctgggcaagctcaagctcgacgcccacgacctcgtcgccctctccggcgcgcacaccgtcggcatcgcgcactgcacttccttcgacaagcgcctcttccctcaagtcgaccccaccatggacaagtggttcgccggccacctcaaggtcacctgcccggtgctgaacaccaacgacaccaccgtcaacgacatccggacgcccaacaccttcgacaacaagtactacgtcgacctgcaaaaccgccagggcctcttcacctccgaccagggcctcttcttcaacgcaaccaccaagccgatcgtcaccaagttcgccgtcgaccagtcggccttcttcgaccagtacgtctactccgtcgtcaagatgggcatgatcgaggtgctcaccggctcgcaggggcagatccgcaagcgctgttcggtgtccaacgccgccgccgccggcgaccgtgcttggtccgtcgtggagaccgtcgctgaggccgccgagagcttggtgctgtag

SEQ ID NO: 742 - protein, 356 aa, Oryza sativa; identical to SEQ ID NO: 114

SEQ ID NO: 743 - DNA, 1851 bp, Oryza sativa
  misc_feature (93)..(93): n = any nucleotide
atggagaggggctgggaaaagagagttgcaaacacagccacagaaggacagaagggtgtcccggtcctcctggcttcgagaagcggccttacntcgcgggacgccgtccttgggttgggattggggtgcgggctcttgagacggaggagcggcgctagtggtggtggtggtggtggggtctcttgcggcgcgcagcctgccgcggcggcggcggcgggggcggtgccggcggcgcagccggaggggaagaagttcctcggcgtggaggtgaagacgctgaagaagatcgtgccgctcgggttgatgttcttctgcatcttgttcaactacacgatcctgcgggacaccaaggacgtgctggtggtgaccgccaaggggagcagcgcggagatcatcccgttcctcaagacgtgggtcaacctgcccatggccatcggcttcatgctcctctacaccaagctctccaatgtgctctccagggaggcgctcttctacaccgtcatcttccccttcatcgccttcttcggcgcctttgccttcgtgctctaccctctcaggaatgtgatccaccccaccgcgctcgccgacaagctccttgcggcgctcggcccgagctttcttggccccgtcgccattctgaggatttggagcttttgcttgttctatgtcatggccgaactgtggggcagcgtcgtcatctcggtcctcttctggggcttcgctaaccagattactacagttgaggaagcaaaagaattctaccctctatttggtcttggggctaatattgcgctcatcttttctgggcgtactgtgaagtatttctcaaatctgcgcaagacattgggtccaggtattgacggatgggaggtgtctttgaaaggaatgatgagcttagtggtgcttcttggacttgtcatcacttccatctattggggggtgaacaagtttgttttgaatgatccttctcttccgaagtctgaccgtaagaagaaaaaggataaacctaagcttggaatgaaagagagtcttaaagttctcctctcctcaagatatgtaagggaccttgctactttagtggttgcatatggcatcagtatcaaccttgtggaggtcacatggaaatcgaagctcaaggcacagttccctagtccaaatgagtattcatctttcatgggtgatttctcaaccgctactggcattgctactttcacaatgatgctgttaggccggatcatactccgaaaattcggctggggagtggctgcaatgatcacccccacagttttgttgctgactggcgtcggtttcttctccctgattctatttgggcagcctctcactcctatgcttgccacaatgggcatgacccctcttcttgcagcagtttatgtgggtgcacttcagaacatattcagcaagagtgcaaagtatagtttatttgatccatgcaaagaaatggcctacattcctttggatgaagatatgaaggtgaagggaaaggcagccattgatgttgtctgcaacccattggggaagtctggtggagctcttattcaacagttcatgatccttacatttggctctttagctaactccaccccctaccttggtggcatactgttggtgattgttctagcatggctaggcgcggcaagttcactagacaagcaattctctagcttggctaaggaagatctcaaaagggatatgtctgcaaaagagaaggtagatccttccctgctcaaggctcctgaggctgatgtattggtggagcacacaaacggcactatagagagcgaagctactgcaactgagagttcaccatcaaactcatctccaagtaattag

SEQ ID NO: 744 - protein, 616 aa, Oryza sativa
MERGWEKRVANTATEGQKGVPVLLASRSGLTSRDAVLGLGLGCGLLRRRSGASGGGGGGVSCGAQPAAAAAAGAVPAAQPEGKKFLGVEVKTLKKIVPLGLMFFCILFNYTILRDTKDVLVVTAKGSSAEIIPFLKTWVNLPMAIGFMLLYTKLSNVLSREALFYTVIFPFIAFFGAFAFVLYPLRNVIHPTALADKLLAALGPSFLGPVAILRIWSFCLFYVMAELWGSVVISVLFWGFANQITTVEEAKEFYPLFGLGANIALIFSGRTVKYFSNLRKTLGPGIDGWEVSLKGMMSLVVLLGLVITSIYWGVNKFVLNDPSLPKSDRKKKKDKPKLGMKESLKVLLSSRYVRDLATLVVAYGISINLVEVTWKSKLKAQFPSPNEYSSFMGDFSTATGIATFTMMLLGRIILRKFGWGVAAMITPTVLLLTGVGFFSLILFGQPLTPMLATMGMTPLLAAVYVGALQNIFSKSAKYSLFDPCKEMAYIPLDEDMKVKGKAAIDVVCNPLGKSGGALIQQFMILTFGSLANSTPYLGGILLVIVLAWLGAASSLDKQFSSLAKEDLKRDMSAKEKVDPSLLKAPEADVLVEHTNGTIESEATATESSPSNSSPSN

SEQ ID NO: 745 - DNA, 1377 bp, Oryza sativa
atgactccgaagaagtcaattggaacctctcaaccccagcctgtgtttcagttcttctccgggaacctcggagagatcaagaggttccgcggcgatggcgctggcgtcgtgctcaacgtctcctcccatgacttcctccccattgtacagccacatttccgcaagtggattcccctatatggaaggacattcctgtattggttcggagcacagccaaacatatgcttggctgacgtgagcatggtgtggcaggtattgtcagaccggacggggatataccccaagaacctgacgaaccctcactttgtgcgtctacttggcaaggggcttgtgctcactgacggcgatgagtggaagcgccaccgcaaggtggtccacccggcctttaacatggacaagctcaagatgatgacgatgaccatgtctgactgctctcggtccatgatgtcggagtgggaatcggagttggcggcgaagggtggtcttgttgagattgagctaagcaggcggttcgaggagctcactgccgatgtgatctcgcacacggcgtttggtagcagctacaaggaggggaagcaggtcttcctggcacagagggagctccaatttcttgccttctccaccttcctcactgttcaaattccagggtttagctaccttccgaccatgaaaaacttcaagacatggtcgctcgacaagaaggtgaggggcatgctcatggacatcatcaagacccggcatgccaacaaggatgtagctgggtatgggaatgacctacttgggttgatgctggaggcatggcatgacaccacatcacacttgctcacctggaccatgttcctgctgagcacgcacccagattggcaggagaaattaagggaggagattgcaatggagtgtggtgacaaggtgcccactggtgacatgctcaacaagctaaagatggtcaacatgttcctcctagagaccctaaggctgtacagccctgtctcactcatacggaggaaggttgacactgatattgagctcggcggcatcaagatgcctgagggtgcactattgacgatcccgatcgcgacaattcaccgtgacaaggaagtgtggggggaggatgcggatgagtttaggccggagaggttcgagaatggggtgacgagggcagcgaagcaccccaacgcactactctccttctccagcggaccgaggtcatgcattgggcagaactttgcaatgatcgaggccaaggctgtcattgccatgatcctacagaggttctccttcactttgtcccccaagtacgtccatgcacccactgatgtgatcacgctgcgtcccaagtacgggctccctatgatcctcaagagcctcaagctgtag

SEQ ID NO: 746 - protein, 458 aa, Oryza sativa
MTPKKSIGTSQPQPVFQFFSGNLGEIKRFRGDGAGVVLNVSSHDFLPIVQPHFRKWIPLYGRTFLYWFGAQPNICLADVSMVWQVLSDRTGIYPKNLTNPHFVRLLGKGLVLTDGDEWKRHRKVVHPAFNMDKLKMMTMTMSDCSRSMMSEWESELAAKGGLVEIELSRRFEELTADVISHTAFGSSYKEGKQVFLAQRELQFLAFSTFLTVQIPGFSYLPTMKNFKTWSLDKKVRGMLMDIIKTRHANKDVAGYGNDLLGLMLEAWHDTTSHLLTWTMFLLSTHPDWQEKLREEIAMECGDKVPTGDMLNKLKMVNMFLLETLRLYSPVSLIRRKVDTDIELGGIKMPEGALLTIPIATIHRDKEVWGEDADEFRPERFENGVTRAAKHPNALLSFSSGPRSCIGQNFAMIEAKAVIAMILQRFSFTLSPKYVHAPTDVITLRPKYGLPMILKSLKL

SEQ ID NO: 747 - DNA, 741 bp, Oryza sativa
atgtggtgccagtcgtgcaaggaggagtacgaggaggaggacgccgggacgtgcaaggagtgctacgaggaggcgagcgagacggaggaggagctcaagcgcgagatcgacgacctccgctcccgcctccacttcctccgcctcccttccccttccctcgacgcctcctccctctcccactccgacctcctcctccacgccatccccgccgatgcgcccgcccgccccgacacccccgccgtccccgcccaccgcgtcatcctcgccagcagatctcctgttttcagagctatgcttgagaacgagatggaagagagccggagtggcatcatcaaaatatacgatgtgtcctacgacgtccttcgtgctttcgtccattacatgtacacagcagaagctctccttgacgagcagatggcatctgatctcctggtgttggctgagaagtacgaagtgaagaacctgaaggcctactgtgagaaattcttaacatccaaagtgagcaacgacaatgccatcacgcattatgcgtttgcgcatcgccacagcgcgaagcagctgctcgagacatccctggcagcgatcatggacaacatgtcaacgctggcagatcgggaggaatacaaggagcttgttgagaaggacccaaggcttgttgtggagatatatgaagcctatctgaacagacaagtgaacactgctgctgggaaggagacagattccagtagtaggaaggggtaa

SEQ ID NO: 748 - protein, 246 aa, Oryza sativa
MWCQSCKEEYEEEDAGTCKECYEEASETEEELKREIDDLRSRLHFLRLPSPSLDASSLSHSDLLLHAIPADAPARPDTPAVPAHRVILASRSPVFRAMLENEMEESRSGIIKIYDVSYDVLRAFVHYMYTAEALLDEQMASDLLVLAEKYEVKNLKAYCEKFLTSKVSNDNAITHYAFAHRHSAKQLLETSLAAIMDNMSTLADREEYKELVEKDPRLVVEIYEAYLNRQVNTAAGKETDSSSRKG

SEQ ID NO: 749 - DNA, 624 bp, Oryza sativa
  misc_feature (360)..(360): n = any nucleotide
  misc_feature (480)..(480): n = any nucleotide
atgggcaacgcgatcgccggcgggaggcggcggacggcgagggtgatgacggtggacgggacgacgtacaagtacaggccgccggcgtcggcggcggcggcgctgcgcgaccacccgggctaccaggtcctggagtcggaggaggtcaggcgcctcgggatgcgcgcgcggccgctcgacgccgacgcgccgctcaagcccggcaagctctacttcctcgtcgagctccctcgcctcgcccgcgcgccgcggcgaacgttggagagcatgatgctgtcgcggcggtcggcgtcggacgtggcggcgtcgccggtgtcgtcggtggaggccggcgaaggcggcgccgtgcggctgcggatncggctgcccaaggcggaggtggcgcggcttgtgaaggagagccgcgaagccgccgaggccgccgagaagatcatgcagctctgcgtcgacagggaccacagctccgcgccggccaccccngtcctccgccgcccgccgccgctgccgctgccgctgccgctgccggcggcgctcgtctcgtcggacaagaagaaggtcgccgacaagaagcagaagaaggcgaggtttatgactgacgtacctgacgagatcatcgacttctga

SEQ ID NO: 750 - protein, 207 aa, Oryza sativa
  misc_feature (120)..(120): Xaa = any naturally occuring amino acid
  misc_feature (160)..(160): Xaa = any naturally occuring amino acid
MGNAIAGGRRRTARVMTVDGTTYKYRPPASAAAALRDHPGYQVLESEEVRRLGMRARPLDADAPLKPGKLYFLVELPRLARAPRRTLESMMLSRRSASDVAASPVSSVEAGEGGAVRLRXRLPKAEVARLVKESREAAEAAEKIMQLCVDRDHSSAPATXVLRRPPPLPLPLPLPAALVSSDKKKVADKKQKKARFMTDVPDEIIDF

SEQ ID NO: 751 - DNA, 1632 bp, Oryza sativa
atggatccgaggcgcagccactgggagagctcgtcggaggacgtgacgaggccgctgctcccgctgcacgacgacgacggcgcggcgggccggcgctcctgcgccgcgctgaggtcgctgctcgccaacaagtacctggcggtcgcgtcgggccccgtggcgtgcgcgctgatctgcggcctcgtcgacctcggcggccaccgcgccgcgcgcaacatgctcggggtgctcgcctgggtgttcctgtggtggattaccgacgccgtgccgctcgccgtcgcgtccatggcgccgctgttcctcttccccgtgttcggcatctcctcctccgacgccgtcgccaaggcctacatggacgacgtcatctccctcgtcctcggcagcttcatcctcgcgctcgccatcgagcactacaacatccaccgccgcctcgctctcaacatcacgtcgctgttctgcggcgacccggtgaagccgccgctgctgctgctgggaatctgcggcaccaccatgttcatcagcatgtggatccacaacacaccgtgcaccgtgatgatgatgccggtggcgacggggatcctgcagcggttcccgcgcgtcgacggggcgtcgtcctcggcgagcagcgccgcggacgcgcgggaggtgcagcggttctccaaggcggtggtgctcggcgtcgtgtacgcgtcggcgatcggcgggatggcgacgctgacgggcaccggcgtgaacatcatcctggtggggatgtggtccacctacttcccggagcagccgcccatcaccttcagctcgtggatgtcgttcgggctcccattggcgctcgtcctcttcgtcgcgctctgggccacgctctgcgtcctgtactgctccaagaacaccgggagggcgctctcagcttacctggacaggagccatctcaggagggagctcagcttgcttggtcctatggcttttgcagagaagatggttctagccgtttttgggggtttgattgtcctatggatgacgaggagcctgacagatgatattcctgggtggggatcactcttccacggcgaagttggggatggaactgtcactatcatgatggcgacgctgctgttcataatcccgagcggcaagaacgacggcgagaagctcatggactggggcaagtgccggaggctgcagtggaacatcatcctcctcctcggcgccggcttcgccatcgccgacggcttcagggcgagcggcctgaccgacatcctctccgaggggctcggcttcctccgcggcgcgccggcgctggccatcgcgcccgtggcgtgcgtcttcagcggcgccatcaccgagttcacctccgacgacgcgaccgccacgctggtgctcccgctgctcgccgagctgggcaagtccatcggcgtgcacccgctcctcctcatggtccccggcgccgtcggcgcgcagctgtcctacctgctgcccaccggctcgccgggcaacgtcgtcggcttcagcacgggctacatcagcatcaaggacatggtgatcgccggaacgcccctgaaaattgtcggggttgcagctctcaccatcctactgccaacgttaggatccgtcgtttttggcatggatcagaagctatag

SEQ ID NO: 752 - protein, 543 aa, Oryza sativa
MDPRRSHWESSSEDVTRPLLPLHDDDGAAGRRSCAALRSLLANKYLAVASGPVACALICGLVDLGGHRAARNMLGVLAWVFLWWITDAVPLAVASMAPLFLFPVFGISSSDAVAKAYMDDVISLVLGSFILALAIEHYNIHRRLALNITSLFCGDPVKPPLLLLGICGTTMFISMWIHNTPCTVMMMPVATGILQRFPRVDGASSSASSAADAREVQRFSKAVVLGVVYASAIGGMATLTGTGVNIILVGMWSTYFPEQPPITFSSWMSFGLPLALVLFVALWATLCVLYCSKNTGRALSAYLDRSHLRRELSLLGPMAFAEKMVLAVFGGLIVLWMTRSLTDDIPGWGSLFHGEVGDGTVTIMMATLLFIIPSGKNDGEKLMDWGKCRRLQWNIILLLGAGFAIADGFRASGLTDILSEGLGFLRGAPALAIAPVACVFSGAITEFTSDDATATLVLPLLAELGKSIGVHPLLLMVPGAVGAQLSYLLPTGSPGNVVGFSTGYISIKDMVIAGTPLKIVGVAALTILLPTLGSVVFGMDQKL

SEQ ID NO: 753 - DNA, 1110 bp, Oryza sativa
atggcaacatcctttctcttctctctcattctcctcctcatcactgccctttctcttccctttcctctccatgcgtcatctgtagaccccttgagcgccggtgcgaccaccgtccgctactggaatcgcaagattcctaacaatgctcctcaccccgacttcttcctttcactcctctcccctcttcccgcatctgtctcctcttccctctcctctccgctctccatatccccatccatctgccgctctgctcgcctcctctgccctaactctacctattttcagtccctctcaagcactgtcttcatagatggatgcacctttagttactcatgcaccttcacatacgaacataccaacatcactataaagcctggtatattttttcgggagcaagaattgaaagaggggaatgtggtcagaatgccagatatagcgaatgagttgacgacggctcgttcgtcgttccttccccgatcgatcgcggataggatcccattcaaggctgaggctgtcaagtccctgttcgggctagagccaaacacaaccttggcaaaggctgtggatgaaacggtggcgcaatgccagagctcgccaagcaagggcgagacgaagcggtgcgtcacatcagcagaggacatgatcgactttgccgtggcgatgttaggtgatgacattgtggttcggagtaccgtactgccaaatgggcccggcgagtcgatcatgattggtaaggtcaagggaataaatggtggcaagattaccagctcggtatcatgccacgaatacttatttccatacatggtatactactgccactcggtgcctaaaatcagagtttatgaggccgagatcctgtccgtccagacgaaggagaagatcaacagcggtgtcgccatctgtcacattgacacgtctgcctggaatgctgggcatcctgcttttgtggcactaggtgggaagccagacctgctccgattaaacgtgtcttcgtgtctccctttggaatcttctgaatccctcctcgaagatgatgccactgtatttgtcgaggaagaggaggatctgggagaagtgatcgagttacctaaaaccgatccgctttcatga

SEQ ID NO: 754 - protein, 369 aa, Oryza sativa
MATSFLFSLILLLITALSLPFPLHASSVDPLSAGATTVRYWNRKIPNNAPHPDFFLSLLSPLPASVSSSLSSPLSISPSICRSARLLCPNSTYFQSLSSTVFIDGCTFSYSCTFTYEHTNITIKPGIFFREQELKEGNVVRMPDIANELTTARSSFLPRSIADRIPFKAEAVKSLFGLEPNTTLAKAVDETVAQCQSSPSKGETKRCVTSAEDMIDFAVAMLGDDIVVRSTVLPNGPGESIMIGKVKGINGGKITSSVSCHEYLFPYMVYYCHSVPKIRVYEAEILSVQTKEKINSGVAICHIDTSAWNAGHPAFVALGGKPDLLRLNVSSCLPLESSESLLEDDATVFVEEEEDLGEVIELPKTDPLS

SEQ ID NO: 755 - DNA, 858 bp, Oryza sativa
atggcggcgatctcgcgcgcgatccgggcgtgcgccgccgcggggtcccggcggagcatggcgtcgtcggcgaaggaggtggcggcggccggggcgcgggcggcggcggcggtggcgcggcgcgggcgggagcgggagcgggaggaggacgggaggcgcgtgcagtgggtgttcctgggctgccccggggtggggaagggcacctacgccagccgcctctcgcagatgctccgcgtgccccacatcgccaccggcgatctcgtccgcgacgccctcgcctccccgggccccttctccgagcagcttgcggagattgtgaataatggaaagctagtgtcggatgagatcataataaatcttctgtcaaagcggcttgaagagggagcagaaaagggtgagctgggcttcatccttgatggttttccaagaaccataagacaagcggagatacttgaaggagtcacggatattgatttggtcatcaacctcaaactccgagaagaggctctgcttgcaaaatgccttggtagaaggatgtgcagccagtgtggtggaaattttaatgtagcgtccattgatatggagggcgaaaatggtggtcctcgaatgtacatgcctccactactgcctcctccacagtgtgaatcaaagttgataactaggcctgatgatactgaagaggtggtaaaggagcgattgcgtgtttatcatgatttgtgtgagccagtggaggacttctacagagcacgtggtaaactattggagttcaatctaccaggaggaattccagaatcatggccgaagttactgcaagcattgaatttagaccctggcaatgaaagatctgcagcagcatga

SEQ ID NO: 756 - protein, 285 aa, Oryza sativa
MAAISRAIRACAAAGSRRSMASSAKEVAAAGARAAAAVARRGREREREEDGRRVQWVFLGCPGVGKGTYASRLSQMLRVPHIATGDLVRDALASPGPFSEQLAEIVNNGKLVSDEIIINLLSKRLEEGAEKGELGFILDGFPRTIRQAEILEGVTDIDLVINLKLREEALLAKCLGRRMCSQCGGNFNVASIDMEGENGGPRMYMPPLLPPPQCESKLITRPDDTEEVVKERLRVYHDLCEPVEDFYRARGKLLEFNLPGGIPESWPKLLQALNLDPGNERSAAA

SEQ ID NO: 757 - DNA, 1656 bp, Oryza sativa
  misc_feature (102)..(102): n = any nucleotide
  misc_feature (126)..(126): n = any nucleotide
atgtgtgacaaggatccgggcataaagctcttcgggcgggtgatcccgctggctccagaggctgaggctgctgcggcggcggacggctccgaccagccggangcggcggcggcggcggcggcggangttgagccggcggcgcaggatgaggatcatcacaaggaaacagaagaaagaaaatatgatgaaatgaaggttgatgtgccacaagaggaggaagataacgaaatgaaggtcgatgcaccacaagagaaaaaggataatgaagtgacggctgatgtgccagaagagaagggaaatgatgaaatgagggttgatgcatcagagtcaatagaaagcatagagccagtcagcagatctaccttggacaataaaaaagaagatcagggtcagatgaacaacgttgaagagaaagcagcatcagactcaaaagatgaaaatgaaaagacagcaaatgatgaatcaggccaggacaaagtacttaagaagccagataagattctcccttgccctcggtgcaacagtatggacacaaagttttgttattacaacaactacaatgttaatcaacccaggcacttctgtaagaactgccaaaggtattggactgccgggggaaccatgagaaatgtacctgttggtgctgggaggcgcaaaagcaagagctcatcgttgcactaccgtcacttactgatggcccctgattgcatgatggggtctagagtggaaatatccaagtcaatgaaccctgaagctttcgcatctgcgcattcgacccctatacaaccaattggcagaaacgaaacagttctcaaatttgggcctgaggtgccactctgtgaatcgatggcatcagtgctgaacattcaggagcagaatggaaccaatgctgcagcagtaccaacgggtgaaaatcaggaagataactcttgcatctcttcaatcacatcacacaacgtgttacctgaaaatgcagcccaagttgacaagaacagcacgccggtgtattgcaacggagtcggcccagtgccgcagtactaccttggagctccttacatgtacccatggaacataggatggaacaacgttcctatgatggtgccaggtacaagcatgccagagtctgcttcccaatctgagagctgcagcaccagttcagctccatggatgaacatgaactcccccatgatgccggttgcctcgaggctttctgcaccaccatttccataccctctagtgccacctgcactatggggttgcttatccagctggccggccacggcatggaacataccgtggatcagaacgaatggcggctgcatgtctccatcgtcgtcgagcaacagcagctgttcaggcaatggctcccctctggggaagcattccagggactcctctctcccactgaaggaggacaaggaggagaaatcactgtgggttcccaagacgctccgcatcgacgatcccgacgaggcggcgaagagctccatctgggccaccctggggatcaagcctggagaccctggcatcttcaagccgttccagtccaaaggtgagagcaaaggccaagcagcatcagagactcgtcctgctcgtgctcttaaggcaaacccagctgcattgtcgcggtcgcagtcgttccaggagacttcttga

SEQ ID NO: 758 - protein, 551 aa, Oryza sativa
MCDKDPGIKLFGRVIPLAPEAEAAAAADGSDQPDAAAAAAADVEPAAQDEDHHKETEERKYDEMKVDVPQEEEDNEMKVDAPQEKKDNEVTADVPEEKGNDEMRVDASESIESIEPVSRSTLDNKKEDQGQMNNVEEKAASDSKDENEKTANDESGQDKVLKKPDKILPCPRCNSMDTKFCYYNNYNVNQPRHFCKNCQRYWTAGGTMRNVPVGAGRRKSKSSSLHYRHLLMAPDCMMGSRVEISKSMNPEAFASAHSTPIQPIGRNETVLKFGPEVPLCESMASVLNIQEQNGTNAAAVPTGENQEDNSCISSITSHNVLPENAAQVDKNSTPVYCNGVGPVPQYYLGAPYMYPWNIGWNNVPMMVPGTSMPESASQSESCSTSSAPWMNMNSPMMPVASRLSAPPFPYPLVPPALWGCLSSWPATAWNIPWIRTNGGCMSPSSSSNSSCSGNGSPLGKHSRDSSLPLKEDKEEKSLWVPKTLRIDDPDEAAKSSIWATLGIKPGDPGIFKPFQSKGESKGQAASETRPARALKANPAALSRSQSFQETS

SEQ ID NO: 759 - DNA, 1098 bp, Oryza sativa
  misc_feature (628)..(628): n = any nucleotide
atgggggtggtcagcttctcctcgacttcctccggcgcgtccacggccaccaccgagtccggcggcgccgtgcggatgtcgccggagccggtggtggcggtggcggcggcggctcaacagctaccggtggtgaagggagttgactcggcggatgaggtggtgacgtcgaggccggcggcggcggcggcgcagcagtcgtcgcggtacaagggggtggtgccgcagccgaacgggaggtggggggcgcagatctacgagcggcacgcgcgggtgtggctcgggacgttccccgacgaggaggcggcggcgcgggcctacgacgtggcggcgctccggtaccgggggcgcgacgcggccaccaacttccccggggccgcggcgtcggccgccgagctcgcgttcctcgccgcgcactccaaggccgagatcgtcgacatgctccggaagcacacctacgccgacgagctccgccaggggctccgccgcggccgcggcatgggcgcccgcgcccagcccacgccgtcgtgggcgcgcgagccgctgttcgagaaggccgtgacgcccagcgacgtcggcaagctcaaccgcctcgtggtgcccaagcagcacgccgagaagcacttcccgntccgccgcgcggcgagctccgactccgcctccgccgccgccaccggcaagggcgtgctcctcaacttcgaggacggcgaggggaaggtgtggcgattccggtactcgtactggaacagcagccagagctacgtgctgaccaaggggtggagccgattcgtgagggagaagggcctccgcgccggcgacaccatagtcttctcccgctcggcgtacggccccgacaagctgctcttcatcgactgcaagaagaacaacgcggcggcggcgaccaccacctgcgccggcgacgagaggccaaccacaagcggcgccgaaccacgcgtcgtgaggctcttcggcgtcgacatcgccggcggcgattgccggaagcgggagagggcggtggagatggggcaagaggtcttcctactgaagaggcaatgcgtggttcatcagcgtactcctgccctaggtgccctgctgttatag

SEQ ID NO: 760 - protein, 365 aa, Oryza sativa; identical to SEQ ID NO: 410

SEQ ID NO: 761 - DNA, 804 bp, Oryza sativa
atggtgcagtgtctcgacggggtgaggcagctgctggcggtcgtgttcaagtgctgcgacctcgagctgaagcagccgcgggggctcgaggatccccaggtcctcgcgagggagaccgtcttcagcgtgagcgaggtcgaggcgctgtacgagctcttcaagaagataagcagtgctgtgattgatgacgggctgattaacaaggaggagtttcagttggcgctgttcaagaccagcaagaaggagagcctgttcgccgaccgtgtatttgatttgtttgacacaaaacacaatggaattttaggatttgatgaatttgctcgtgcactctcagtatttcatccaagtgctccacttgatgagaagattgacttttcattccagttatatgatctcaagcaacaaggctatattgagagacaagagtttataaaattgatttatcaggttaagcagatggttgttgctacacttgctgagtctggaatgaatctttctgatgaaattatagagagcataatcgataagacatttgaggaggcagacacaaagcatgatggaagaattgataaagaagagtggcgcaatctggttcttcgtcatccctctttgctgaagaacatgactctccagtacctcaagtcgatgacacctgaattcttggatttgtttgaactcaaaccatcagaagaatgctcatgccggttcattaagaattttgatattgggttgttggattgggcagagactccagagctctgtaggatgttgcatgttcgatttgagaagttctcaaatctttaa

SEQ ID NO: 762 - protein, 267 aa, Oryza sativa
MVQCLDGVRQLLAVVFKCCDLELKQPRGLEDPQVLARETVFSVSEVEALYELFKKISSAVIDDGLINKEEFQLALFKTSKKESLFADRVFDLFDTKHNGILGFDEFARALSVFHPSAPLDEKIDFSFQLYDLKQQGYIERQEFIKLIYQVKQMVVATLAESGMNLSDEIIESIIDKTFEEADTKHDGRIDKEEWRNLVLRHPSLLKNMTLQYLKSMTPEFLDLFELKPSEECSCRFIKNFDIGLLDWAETPELCRMLHVRFEKFSNL

SEQ ID NO: 763 - DNA, 771 bp, Oryza sativa
atggagtctagtacgctactgaaggacaccatgatctcaactagggctaaaatttacaagctctatatgcccagatgtacaggcttgactgctgaaggtgtggtgaagattgtccaggttctttatgaatgcaaggggaatctaaaccgcattcgactccatggtatttgcaggatgactaagcatcatcttgatgctatcagttctgccatgtgcaagggtaaccaacaagaagatgatcaatcacttttctatagccacagagtccatgaagtgctcaacaccaacgatgaacgccgtattgatgttgatgtgtgccctatgtgcacaaatgtgaggctggtgtttgattgtacaagggatggctgtaggagaaaggatagttgggctcaatgtcgaggctgcttcttctgtgttgcccgatgcgaaacatgcggtgggtgcatcgacttggaggagctcagcgagactgaacttgcatgctcggacttcctgtgcatggagtgctggcttccgctcccgaaatgtagcacttgcaatcggccctactgcaagaggcatgaaaatctgaagataataaattatcacattcatgttttcaaagcacctaaatggtggcagcagcagattggtcctccaaaatttcgacatgtgaaaaaggaaccttgctactacacccttcaccagatacttagtgttggtgccaaactgcccaatcaagatatgccagggaaaagaaatgatgaagtgcactactttaccctaaattga

SEQ ID NO: 764 - protein, 256 aa, Oryza sativa
MESSTLLKDTMISTRAKIYKLYMPRCTGLTAEGVVKIVQVLYECKGNLNRIRLHGICRMTKHHLDAISSAMCKGNQQEDDQSLFYSHRVHEVLNTNDERRIDVDVCPMCTNVRLVFDCTRDGCRRKDSWAQCRGCFFCVARCETCGGCIDLEELSETELACSDFLCMECWLPLPKCSTCNRPYCKRHENLKIINYHIHVFKAPKWWQQQIGPPKFRHVKKEPCYYTLHQILSVGAKLPNQDMPGKRNDEVHYFTLN

SEQ ID NO: 765 - DNA, 873 bp, Oryza sativa
  misc_feature (66)..(66): n = any nucleotide
  misc_feature (364)..(364): n = any nucleotide
  misc_feature (408)..(408): n = any nucleotide
  misc_feature (426)..(426): n = any nucleotide
atggctgctaataagctcaagttctcccctctccttgccctcttcctcctcgccggcatagccgtnacctcccgtgccggcgacatcgccgtgtactggggccagaacggcgacgagggcagcctggccgacgcctgcaactccggcctatacgcgtacgtcatggtcgccttcctcagcaccttcggcaacggccagacccctgtcctcaacctcgccgggcactgcgaaccaagctccggcggctgcaccggccagagctcggacatccagacgtgccagtcgctgggcgtcaaggtcatcctgtccatcggcggcggcgccggcagctacgggctgtcgtccacccaggacgcccaggacntggccgactacctgtggaacaacttcctcggcggcagctcgggntcccggccgctcggcgangccgtgctggacggcgtcgacttcgacatcgagaccggcaacccggcgcactacgacgagctcgccacgttcctgtcgcggtacagcgcgcaggggggcggcaagaaggtgatcctgacggcggcgccgcagtgcccctacccggacgcgtcgctggggccggcgctgcagacggggctgttcgacagcgttaacgccaacggcgacgccagcaacctggtgagcgcgtggaacacgtggaccggcggcgtcagcgccgggagcttctacgtcggcgtgccggcggcggaggccgcggcggggagcgggtacgtggcacccggcgacctgacgtcggcggtgctccccgccgtgcagggcaacgccaagtacggcggcatcatggtgtggaaccggttctacgacgtgcagaacaacttcagcaaccaggtgaagagcagcgtctga

SEQ ID NO: 766 - protein, 290 aa, Oryza sativa
MAANKLKFSPLLALFLLAGIAVTSRAGDIAVYWGQNGDEGSLADACNSGLYAYVMVAFLSTFGNGQTPVLNLAGHCEPSSGGCTGQSSDIQTCQSLGVKVILSIGGGAGSYGLSSTQDAQDLADYLWNNFLGGSSGSRPLGEAVLDGVDFDIETGNPAHYDELATFLSRYSAQGGGKKVILTAAPQCPYPDASLGPALQTGLFDSVNANGDASNLVSAWNTWTGGVSAGSFYVGVPAAEAAAGSGYVAPGDLTSAVLPAVQGNAKYGGIMVWNRFYDVQNNFSNQVKSSV

SEQ ID NO: 767 - DNA, 2817 bp, Oryza sativa
  misc_feature (312)..(312): n = any nucleotide
atggccgcttccgtgcagccgcggcagttcggccacctcgagccgggctccgcgccggtgtgcggcgccgcatcctcgaacggcgccaaggcgtaccctcccgcgaacggcatcccgcgccgcgccgactcaccggtgcgcgggtgcggcttccctcccctcgtctcgccaccttcgcggaagccgcccagcgatgggtcggacgacgaggaggaggagcaggaggactggcgggagctgtacggctcgcacctgcagctggaggtggaaccgtcggtgcgcgacgcgcgcaacgagggcaccgccgacgcntggatcgagcgcaacccgttgctgatccggctcaccgggaaacacccgctgaactgcgaggcgccgctggcgaggctcatgcaccacggcttcatcaccccggctgcgctgcacttcgtgcgcaaccacggcgcagtgccgcggggtgactggtcgacgtggaccgtcgaggtgacggggctcgtcaagcgtcccatgcggctcaccgtggacgagctggtcaacggcttccccgccgtggaggtccccgtcacgctggcctgctcggggaaccgccgcaaggagcagaacatggtgcagcagactgtggggttcaactttggcgccgccgccgtgtccacgtcggtgtggcacggcgcccgcctccgcgacgtgctccggcggtgcggcatcatgcccagcaagggcggtgcgctcaacgtgtgcttcgagggcgccgaggacctccccggcggcggcggctccaagtacggcaccagcatcacacgccagtgggcgctggacccgtcgcgggacatcatgctcgcctacatgcagaatggcgagccgctgctccccgaccacggcttccccgtccgcgccatcatccccggctgcaccggcggccgcatggtcaagtgggtcaagcgcatcatcgtcaccaccgccgagtccgacaactactaccattacaaggacaaccgcgtcttcccgtcccatgtcgacgccgagctcgccaacgccgatgcgtggtggtacaagccggagtacatcatcaacgagctgaacgtgaactcggtgatcacggcgcccgggcacgacgagatcctgcccatcaacggcatcaccacgcagcgcggctacaccatgaagggatacgcctactccggcggcggcaagaggatcacgcgggtggaggtgacgctggacggccggcgagacatggcttggtgtgcgtgctggacctcccggagaagccccaccaagtacggcaagcactggtgcctggtcgaggtgctcgacctcctcggcgccaaggagatcgccgtgcgcgcctgggaccagtcgcacaacacccagcccgagaagctcatctggaatctcatggtgcttcattccgtctccggccaaggcgacggcgatgtagacgacgatggcaaattcattcgatcggttgggtttttgcaggggatgatgaacaactgctggttcaaggtgaaggtgaacgtgtgccggccgcacaagggtgagatcgggctggtgttcgagcacccgacgcagcccgggaaccagaccggcgggtggatggcgaggcagaagcacctggagacggcggaggcggccgcaccggggctgaagcggagcacgtcgacgccgttcatgaacaccaccgacggcaagcagtttaccatgtccgaggtgcgcaagcactcgtcgcaggactcggcgtggatcgtcgtccacggtcacgtctacgactgcacggccttcctcaaggaccaccccggcggcgccgacagcatcctcatcaacgccggcaccgactgcaccgaggagttcgacgccatccactccgacaaggccaaggcgctcctcgacacctaccgcatcggcgagctcatcaccaccggcgccgggtacagctccgacaactccgtccacggcgcgtccaacctctcccagctcgcccccatccgcgaggccatcaaggcgccggcgcccgtcgcgctctccagcccgcgcgacaaggtcccctgccaactcgtcgacaagaaggagctctcccgcgacgtccgcctcttccgcttcgcgctgccgtcctccgaccaggtgctcggcctccccgtcggcaagcacatcttcgtgtgcgccagcatcgaagggaaactgtgcatgcgggcgtacacgccgacgagcatggtcgacgaggtcggccacttcgacctcctcatcaaggtgtacttcaagaacgagcaccccaagttccccgatggcgggctcatgacgcagtacctggactcgctccccgtgggcgcctacatcgacgtcaaggggccactcggccacgtcgagtacaccggccgcggcgagttcgtcatcaacggcaagccgcggaacgcgcggcggctggcgatgatcgccggcgggagcgggatcacgcccatgtaccaggtcatccagtcggtgctgcgcgaccagccggaggacacgacggagatgcacctggtgtacgcgaaccggacggaggacgacatcctcctccgcgacgagctcgaccggtgggcggcggagtacccggacaggctcaaggtgtggtacgtcatcgaccaggtgaagcggccggaggaagggtggaagtacggcgtcgggttcgtcacggaggaggtgctgcgggagcacgtgccggagggcggcgacgacacgctcgcgctcgcctgcgggccgccgccgatgatcaagttcgccgtctcgccgaacctggagaagatgaagtacgacatggccaattctttcatcgtgttctaa

SEQ ID NO: 768 - protein, 938 aa, Oryza sativa
  misc_feature (104)..(104): Xaa = any naturally occuring amino acid
MAASVQPRQFGHLEPGSAPVCGAASSNGAKAYPPANGIPRRADSPVRGCGFPPLVSPPSRKPPSDGSDDEEEEQEDWRELYGSHLQLEVEPSVRDARNEGTADXWIERNPLLIRLTGKHPLNCEAPLARLMHHGFITPAALHFVRNHGAVPRGDWSTWTVEVTGLVKRPMRLTVDELVNGFPAVEVPVTLACSGNRRKEQNMVQQTVGFNFGAAAVSTSVWHGARLRDVLRRCGIMPSKGGALNVCFEGAEDLPGGGGSKYGTSITRQWALDPSRDIMLAYMQNGEPLLPDHGFPVRAIIPGCTGGRMVKWVKRIIVTTAESDNYYHYKDNRVFPSHVDAELANADAWWYKPEYIINELNVNSVITAPGHDEILPINGITTQRGYTMKGYAYSGGGKRITRVEVTLDGRRDMAWCACWTSRRSPTKYGKHWCLVEVLDLLGAKEIAVRAWDQSHNTQPEKLIWNLMVLHSVSGQGDGDVDDDGKFIRSVGFLQGMMNNCWFKVKVNVCRPHKGEIGLVFEHPTQPGNQTGGWMARQKHLETAEAAAPGLKRSTSTPFMNTTDGKQFTMSEVRKHSSQDSAWIVVHGHVYDCTAFLKDHPGGADSILINAGTDCTEEFDAIHSDKAKALLDTYRIGELITTGAGYSSDNSVHGASNLSQLAPIREAIKAPAPVALSSPRDKVPCQLVDKKELSRDVRLFRFALPSSDQVLGLPVGKHIFVCASIEGKLCMRAYTPTSMVDEVGHFDLLIKVYFKNEHPKFPDGGLMTQYLDSLPVGAYIDVKGPLGHVEYTGRGEFVINGKPRNARRLAMIAGGSGITPMYQVIQSVLRDQPEDTTEMHLVYANRTEDDILLRDELDRWAAEYPDRLKVWYVIDQVKRPEEGWKYGVGFVTEEVLREHVPEGGDDTLALACGPPPMIKFAVSPNLEKMKYDMANSFIVF

SEQ ID NO: 769 - DNA, 2142 bp, Oryza sativa
  misc_feature (1969)..(1969): n = any nucleotide
atggcgtgcgagaacggtcaggttgctgccgatggcatcaacggcctctgcatggcggcgccccgcgccgacccgctgaactgggggaaggcggcggaggagatgtcggggagccacctcgacgaggtgaagcgcatggtggccgagtaccgccagccgctggtaaagatcgagggcgccagcctgaggatcgcgcaggtcgccgcggtggccgcggccggcgaggccagggtcgagctcgacgagtcggcccgcgagcgcgtcaaggccagcagcgactgggtgatgaacagcatgatgaacggcacggacagctacggtgtcaccaccggcttcggcgccacgtcccacaggaggaccaaggaaggtggtgccctgcaaagagagctcatcaggttcctcaatgccggcgccttcggcacgggcacggacggccacgtcctgtccgccgaggccacgcgcgcggcgatgctcgtccgcatcaacactctcctccagggctactcaggcatccgcttcgagatcctcgaggcgattaccaagctgctcaatgccaacgtcacgccatgcctgccactcaggggcacggttaccgcgtccggcgacctggtcccgctctcctacattgccggcttggtcaccggccgcgagaactctgtcgcggtcgctcctgatggcagcaaggtgaacgccgctgaggcgtttaagattgctggcatccaaggtggcttcttcgagttgcagcccaaggaaggtctcgccatggtgaatggcactgccgtcggctctggacttgcctccacggtgctctttgaggcgaacattcttgctgtccttgccgaggtcctgtccgccgtgttctgcgaggtgatgaacggcaagccggagtacaccgaccacctgacacacaagctgaagcaccaccctggacagatcgaggctgctgccatcatggagcacatcttggaaggcagctcgtacatgaagctggcgaagaagctcggtgagctcgacccgttgatgaagccgaagcaagaccggtacgcgctccgcacgtcgccgcaatggcttggccctcagatcgaagttattcgtgcggccaccaagtccattgagcgcgagatcaactctgtcaatgacaacccactcattgatgtctcccgcgacaaggcgcttcatggtggtaacttccagggcactcccatcggtgtgtccatggacaacactcgcctcgcaattgctgccatcggcaagctcatgttcgcgcagttctcagagcttgtgaacgactactacaacaacggccttccctccaacctgtccggcgggcgcaacccgagcttggattacggcttcaagggcgccgagatcgccatggcttcgtactgctccgagttgcagttcttgggcaacccagtgaccaaccacgtccagagcgcggagcagcacaaccaggacgtcaactccctcggcctcatctcctccaggaagacagccgaggccgtcgaaatcctgaagctcatgtcctccacgttcttggtcgccctgtgccaggccatcgacctgcggcaaatcgaggagaacgtcaagagcgccgtcaagagctgcgtcatgacagtggccaggaagactctgagcacgagcgccaccggcggtctccacgccgctcgcttctgcgagaaggatcttctccaggagatcgaccgcgaagccgtgttcgcgtacgccgacgacccgtgcagcgccaactacccgctgatgaagaagctccggaacgtgcttgtggagcgcgccctcgccaacggcgcggccgagttcaacgccgagacctcggtgttcgccaaggtcgcccagttcgaggaggagctccgcgcggcgctgccagcggcggtgttggccgcacgggcagctgtggagaacggcacggcggcaacgcccaacagaatcaccgagtgccgctcctacccantgtaccggtttgtgcgcgaggagctcggaaccgcgtacctcaccggcgagaagacgcggtcgcccggcgaggagctgaacaaggtgctcgtcgccatcaaccaaggcaagcacattgatccgctgcttgagtgtctcaaggagtggaacggcgcgcccctgcccatctgctaa

SEQ ID NO: 770 - protein, 713 aa, Oryza sativa
MACENGQVAADGINGLCMAAPRADPLNWGKAAEEMSGSHLDEVKRMVAEYRQPLVKIEGASLRIAQVAAVAAAGEARVELDESARERVKASSDWVMNSMMNGTDSYGVTTGFGATSHRRTKEGGALQRELIRFLNAGAFGTGTDGHVLSAEATRAAMLVRINTLLQGYSGIRFEILEAITKLLNANVTPCLPLRGTVTASGDLVPLSYIAGLVTGRENSVAVAPDGSKVNAAEAFKIAGIQGGFFELQPKEGLAMVNGTAVGSGLASTVLFEANILAVLAEVLSAVFCEVMNGKPEYTDHLTHKLKHHPGQIEAAAIMEHILEGSSYMKLAKKLGELDPLMKPKQDRYALRTSPQWLGPQIEVIRAATKSIEREINSVNDNPLIDVSRDKALHGGNFQGTPIGVSMDNTRLAIAAIGKLMFAQFSELVNDYYNNGLPSNLSGGRNPSLDYGFKGAEIAMASYCSELQFLGNPVTNHVQSAEQHNQDVNSLGLISSRKTAEAVEILKLMSSTFLVALCQAIDLRQIEENVKSAVKSCVMTVARKTLSTSATGGLHAARFCEKDLLQEIDREAVFAYADDPCSANYPLMKKLRNVLVERALANGAAEFNAETSVFAKVAQFEEELRAALPAAVLAARAAVENGTAATPNRITECRSYPVYRFVREELGTAYLTGEKTRSPGEELNKVLVAINQGKHIDPLLECLKEWNGAPLPIC

SEQ ID NO: 771 - DNA, 990 bp, Oryza sativa
atggcttctgcctcttctcttggcctattactgatgctcgcggcgctggtctccacggccaccgcgcatttgtcgccgacgttctacgacacgtcgtgcccccgagccatgtccatcatcaagagcaccgtgacggccgccgtgaacaacgagccacgcatgggcgcgtctctgctcaggctgcacttccacgactgcttcgtccaagcacgccgaaaagtagctaacaggtttgcctgtctgtcagactacggctgtgacgcctcaattttgctggccggaaacgagaggaatgcagccccaaacttttctgtcagaggctacgacgtcatcgacagcatcaagacgcagatcgaggccgtgtgcaagcagaccgtctcctgcgccgacatcctcaccgtcgccgcccgcgactctgtcgtcgcgcttggaggtccgtcatggagtgttccgctagggagaagggactccaccggagccgctaccgcggcccaggtgattagcagccttgctccttctacagatagcctcgcacagctcatcagcgcgtacgcgagcaagggacttagcgccactgacttggttgctctctcaggtgcgcacacgattggtatggcacggtgcaggggcttcaggacgaggctatacaacgagaccaacatcgacgccgcctttgcggcggcgctcaaggccaactgcccggcgacgccgggcagcggcgacggcaacctggcgccgctggacacgacgacgcccaccgcgttcgacaacgcctactaccgcaacctgctgtcgaacaaggggctcctgcactccgaccaggagctgttcagcaacggcagcacggacaacacggtcaggagcttcgcgtccagcgcggcggcgttcggcgccgccttcgcgacggccatggtgaagatggggaacatctcgccgctgaccgggacacagggacagatcaggctcatctgctccgccgtcaactcgtga

SEQ ID NO: 772 - protein, 329 aa, Oryza sativa
MASASSLGLLLMLAALVSTATAHLSPTFYDTSCPRAMSIIKSTVTAAVNNEPRMGASLLRLHFHDCFVQARRKVANRFACLSDYGCDASILLAGNERNAAPNFSVRGYDVIDSIKTQIEAVCKQTVSCADILTVAARDSVVALGGPSWSVPLGRRDSTGAATAAQVISSLAPSTDSLAQLISAYASKGLSATDLVALSGAHTIGMARCRGFRTRLYNETNIDAAFAAALKANCPATPGSGDGNLAPLDTTTPTAFDNAYYRNLLSNKGLLHSDQELFSNGSTDNTVRSFASSAAAFGAAFATAMVKMGNISPLTGTQGQIRLICSAVNS

SEQ ID NO: 773 - DNA, 798 bp, Oryza sativa
atggcaaggggtttgaagaagcatctgaagaggctcaatgcgcccaagcattggatgctcgacaagcttggtggagcttttgcccccaagccatcttctggtcctcacaagtccagggagtgcctgcctctgatcctcattatcaggaacaggctcaagtatgctctgacataccgtgaggttatttctatcctcatgcagcgccatgtcttggttgatggcaaggtcaggactgacaagacctacccagctggtttcatggatgtcatttccatccccaagactggtgagaactacaggcttctgtacgacaccaagggacgtttccgccttcagtctgtcaaggatgaggatgctaagttcaagctttgcaaggttcggtctgtgcagtttggccagaagggaatcccctacctgaacacctatgatggtcgcaccatccgctaccctgacccgatcatcaaggcaaacgacacaatcaagatcgatctggagaccaacaagattgtcgacttcatcaagtttgatgttggcaatgttgtcatggtgactggaggaaggaacacaggccgtgttggtgtgatcaagaacagggagaagcataaaggcagcttcgagaccatccacgttgaggatgccctgggccaccaattcgccacccgtctgggcaatgtgttcaccattggcaagggcaacaagccttgggtgagcctgcccaagggcaagggcatcaagctcagcatcatcgaggagcaaaggaagcgggatgctgccgcccaggctgctgccaacgcttaa

SEQ ID NO: 774 - protein, 265 aa, Oryza sativa; identical to SEQ ID NO: 660

SEQ ID NO: 775 - DNA, 1182 bp, Oryza sativa
atggcaggaatggcacccgaaggctcccagtttgatgctaagcactatgacagcaagatgcaggaactactgcaccaaggtgacaatgaggaattcttcacttcatatgatgaagtttttgagagttttgatgacatgggcctccaagagaaccttctcagaggcatctatgcttatggttttgagaagccatcagctattcagcaaagggggattgttcccttctgcaaagggcttgatcaacttgactatggattggtggagtgccaatccctggtccttgcaccaacacgtgagcttgcccagcaaattgaaaaggtcatgcgtgctcttggtgactacttaggtgtcaaggtgcatgcctgtgttggtggaacctctgtccgtgaggaccaaaggattcttgctagtggtgtgcatgttgttgttggcacacctggacgtgtgtttgacatgctacgtcggcaatctctccgcccagaccacattaagatgtttgtgctggatgaagctgatgagatgctctcccgtggtttcaaggatcagatctatgatatcttccagctccttccaccaaagatccaggtcggagtgttctctgctaccatgcctcctgaggcccttgagatcacccgcaagttcatgaacaagcccgtgaggattcttgtgaagagagatgagcttacccttgagggtatcaagcaattctacgtcaatgtggagaaggaagattggaagctcgacactctttgtgacttgtatgagacactggccatcacccagagtgtcatctttgtgaacacccgccgcaaggtggactggctcaccgacaagatgaggagcagggaccacactgtctctgccacacatggagacatggaccagaacactagggacatcatcatgagggagttccgatctggttcttcccgtgtgcttatcaccactgatctgcttgctcgtggtatcgatgtccagcaagtctcccttgtcatcaactacgacctgcccacccagcctgagaactacctccatcgcattggtcgtagtggtcggtttggcaggaagggagttgccattaactttgtcacccgcgatgatgagaggatgctgttcgacatccagaggttctacaatgtgaccatcgaggagctgccggccaacgtcgctgaccttctctag

SEQ ID NO: 776 - protein, 393 aa, Oryza sativa
MAGMAPEGSQFDAKHYDSKMQELLHQGDNEEFFTSYDEVFESFDDMGLQENLLRGIYAYGFEKPSAIQQRGIVPFCKGLDQLDYGLVECQSLVLAPTRELAQQIEKVMRALGDYLGVKVHACVGGTSVREDQRILASGVHVVVGTPGRVFDMLRRQSLRPDHIKMFVLDEADEMLSRGFKDQIYDIFQLLPPKIQVGVFSATMPPEALEITRKFMNKPVRILVKRDELTLEGIKQFYVNVEKEDWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLFDIQRFYNVTIEELPANVADLL

SEQ ID NO: 777 - DNA, 831 bp, Oryza sativa
atggccaccgtggggcagcctgatgccatgagaaggatcaccgttcactacgtgaatccgccgccgatcgccggcgccggagaagcacacgtcgatggcctcgacgacgaggttcttgattatgtgattggtgatgttcttcaggatcaggagggtctgtatcaatcgatattgtatggcaaatacggggatgacatgagaggggcaagaaacactgctcttgcccaatctgatggtttacattactactatcacggagagaacagcagtggtgaagcaacaacctcgagaaattcagaaatcgaccaacagattgagtatgacttggtgttcgctaggcagctgcaggcaatggataatctgacaattgagacacctgcagatgaagatgatgatataagctgcgtaccctctccatctgactctgaaaccgatgaaccggcagaaggcaacaacgaagaggctgccacacaggatgataacgatgatccagacaacatgacatacgagcaaaggcaggcacttgtggaatctgtaggaaatgagaacagaggtttatctgatctgcttatctcctacttggagacatggaagtacaaatcaggctttttcccaaggaaggcaaaccatgataactgtcctatatgtctatccgctttcagacgccgagaaacactcattacattggcttgcaagcatagttaccatgaaggttgtattgctagatggctcaagattgacaagcgtgtgaggaggcgatcaacaaggctgaccaactatgactcgatgagacggcatatagtggttgcagcatctgctctgcagtattaa

SEQ ID NO: 778 - protein, 276 aa, Oryza sativa
MATVGQPDAMRRITVHYVNPPPIAGAGEAHVDGLDDEVLDYVIGDVLQDQEGLYQSILYGKYGDDMRGARNTALAQSDGLHYYYHGENSSGEATTSRNSEIDQQIEYDLVFARQLQAMDNLTIETPADEDDDISCVPSPSDSETDEPAEGNNEEAATQDDNDDPDNMTYEQRQALVESVGNENRGLSDLLISYLETWKYKSGFFPRKANHDNCPICLSAFRRRETLITLACKHSYHEGCIARWLKIDKRVRRRSTRLTNYDSMRRHIVVAASALQY

SEQ ID NO: 779 - DNA, 951 bp, Oryza sativa
  misc_feature (270)..(270): n = any nucleotide
  misc_feature (273)..(273): n = any nucleotide
atggggatggggatgaggagggagagggacgcggaggcggagctgaacctgccgccggggttcaggttccaccccacggacgacgagctggtggagcactacctgtgcaggaaggcggcggggcagcgcctgccggtgccgatcatcgccgaggtggatctctacaagttcgacccgtgggatctgcccgagcgcgcgctgttcggcgccagggagtggtacttcttcaccccgcgggatcgcaagtatcctaatgggtcacgccccaancgngccgccggcaacgggtactggaaggccaccggcgccgacaagcccgtcgcgccgcgggggcgcacgcttgggatcaagaaggcgctcgtgttctacgccggcaaggcgccgcgaggggtcaagactgattggatcatgcatgagtaccggctcgccgatgctggccgcgccgccgcgggcgccaagaagggatctctcaggttggatgattgggtgctgtgtcggctgtacaacaagaagaacgagtgggagaagatgcagcaggggaaggaggtgaaggaggaggcgtccgacatggttacgtcgcagtcgcactcgcacacccactcgtggggcgagacgcgcacgccggagtcggagatcgtggacaacgaccccttcccggagctggactcgttcccggcgttccagcctgcgccgccgccggcgacggcgatgatggtgcccaagaaagaatcgatggacgacgccaccgcggccgccgccgccgccgccaccatccccaggaacaacagcagcctgttcgtggacctgagctacgacgatatccagggcatgtacagcggcctcgacatgctgccgccgggcgacgacttctactcgtcgctcttcgcgtcgccgcgggtgaaggggacgacgccacgcgccggcgccggcatgggcatggtcccgttctga

SEQ ID NO: 780 - protein, 316 aa, Oryza sativa
  misc_feature (90)..(91): Xaa = any naturally occuring amino acid
MGMGMRRERDAEAELNLPPGFRFHPTDDELVEHYLCRKAAGQRLPVPIIAEVDLYKFDPWDLPERALFGAREWYFFTPRDRKYPNGSRPXXAAGNGYWKATGADKPVAPRGRTLGIKKALVFYAGKAPRGVKTDWIMHEYRLADAGRAAAGAKKGSLRLDDWVLCRLYNKKNEWEKMQQGKEVKEEASDMVTSQSHSHTHSWGETRTPESEIVDNDPFPELDSFPAFQPAPPPATAMMVPKKESMDDATAAAAAAATIPRNNSSLFVDLSYDDIQGMYSGLDMLPPGDDFYSSLFASPRVKGTTPRAGAGMGMVPF

SEQ ID NO: 781 - DNA, 777 bp, Oryza sativa
atggcaccgaagcgaggcggcagggcgccggtgccggcgaagaagaagacggagaaggtgaccaacccgctgttcgagaagaggccgaagcagttcggcatcggcggcgcgctgccacccaagaaggatctgcacaggttcgtgaagtggcccaaggtggtgcgcatccagcgccagcgccgcatcctcaagcagcgcctcaaggttcccccggcgctcaaccagttcacccgcaccctcgacaagaacctcgcaaccaacctgtttaagatgcttctcaagtaccgccctgaggacaaggctgccaagaaggagaggcttttgaagagggcccaggctgaggctgaagggaaaaccgttgaggccaagaagccaattgttgtgaagtatggtcttaaccacgtgacttacctcattgagcagagcaaggcccagctggttgtcatcgctcatgatgttgatccaattgagctggttgtgtggcttccagccctgtgtaggaagatggaggtcccttactgcatcgttaagggcaaagctcgccttggatcgattgttcacaagaagactgcatctgttctgtgcttgaccactgtcaagaacgaggacaagcttgagttcagcaagatcttggaggccatcaaggcgaacttcaacgacaagttcgacgaggtcaggaagaagtggggaggcggcgtcatgggctccaagtcgcaggcgaagaccaaggccagggaaaagcttctcgctaaggaggccgcccagcggatgacctaa

SEQ ID NO: 782 - protein, 258 aa, Oryza sativa
MAPKRGGRAPVPAKKKTEKVTNPLFEKRPKQFGIGGALPPKKDLHRFVKWPKVVRIQRQRRILKQRLKVPPALNQFTRTLDKNLATNLFKMLLKYRPEDKAAKKERLLKRAQAEAEGKTVEAKKPIVVKYGLNHVTYLIEQSKAQLVVIAHDVDPIELVVWLPALCRKMEVPYCIVKGKARLGSIVHKKTASVLCLTTVKNEDKLEFSKILEAIKANFNDKFDEVRKKWGGGVMGSKSQAKTKAREKLLAKEAAQRMT

SEQ ID NO: 783 - DNA, 1584 bp, Oryza sativa
atggcgggagggcagctcaacgtgctgagcacgctcgaccaggcgaagacgcaatggtaccacttcatggcgatcgtcatcgccggcatgggcttcttcaccgacgcctacgacctcttctgcatttccctcgtcaccaagctgctcggccgcatctactacaccgacgattccaaggacacccccggcgcgctcccgcccaacgtgtcggccgccgtcaccggcgtcgcgctctgcggcacgctcgccggccagcttttcttcggatggctcggcgacaagctcggacgcaagagcgtgtatggtttcacgctgattctgatggtcgtgtgctcggtcgcgtccgggctctcgttcgggagctcggccaagggcgtcgtgtctacgctctgcttcttccggttctggctcggcttcggcatcggcggcgactacccgctcagcgccaccatcatgtcggagtacgcgaacaagaggacgcgcggggccttcatcgccgccgtgttcgccatgcaggggttcgggatcctcttcggcgccatcgtcgcgctcgcggtgtcggcggggttccggcacgcgtacccggcgccgtcctactccgacaaccacgccgcgtcgctcgtcccgcaggccgactacgtgtggcgcatcatcctcatgttcggcaccgtcccggcggcgctcacctactactggcggatgaagatgcccgagacggcgcggtacacggcgctcatcgcccgcaacgcgaagcaggcggcggccgacatgtccaaggtgctgcacacccagattgaggagagcgcggaccgcgccgagacggtggccgtcggcggcgagagctggggcctcttctcgcgccagttcctgcgccgccacggcctccacctcctcgccaccaccagcacgtggttcctcctcgacatcgccttctacagccagaacctgttccagaaggacatcttcagcaaggtcgggtggatcccgccggcgaagaccatgaacgcgctcgaggagctctaccgcatcgcccgcgcccaggcgctcatcgcgctctgcggcaccatcccgggctactggttcaccgtcgcattcatcgagatcatgggcaggttctggatccagatcatgggcttcgccatgatgacggcgttcatgctcggcctcgccatcccgtaccaccactggacgacgccggggcaccacaccggcttcatcgtcatgtacggattcaccttcttcttcgcgaacttcgggccaaacagcaccaccttcatcgtgccggcggagatatacccggcgcggctccggtcgacgtgccacggcatctccgccgccgccgggaaggccggcgccatcatcggagcgttcgggttcctgtacgcggcgcaggaccagcacaagcccgagcctgggtaccccagggggatcggcatcaagaacgcgctcttcgtgctcgccggcacaaacttcctcgggacgatcatgacgctgctcgtgccggagtccaagggcatgtcgctcgaggttatctcgcaggaggtcgccgacggcgacgacgaggaggcggcctacccgaagtaa

SEQ ID NO: 784 - protein, 527 aa, Oryza sativa
MAGGQLNVLSTLDQAKTQWYHFMAIVIAGMGFFTDAYDLFCISLVTKLLGRIYYTDDSKDTPGALPPNVSAAVTGVALCGTLAGQLFFGWLGDKLGRKSVYGFTLILMVVCSVASGLSFGSSAKGVVSTLCFFRFWLGFGIGGDYPLSATIMSEYANKRTRGAFIAAVFAMQGFGILFGAIVALAVSAGFRHAYPAPSYSDNHAASLVPQADYVWRIILMFGTVPAALTYYWRMKMPETARYTALIARNAKQAAADMSKVLHTQIEESADRAETVAVGGESWGLFSRQFLRRHGLHLLATTSTWFLLDIAFYSQNLFQKDIFSKVGWIPPAKTMNALEELYRIARAQALIALCGTIPGYWFTVAFIEIMGRFWIQIMGFAMMTAFMLGLAIPYHHWTTPGHHTGFIVMYGFTFFFANFGPNSTTFIVPAEIYPARLRSTCHGISAAAGKAGAIIGAFGFLYAAQDQHKPEPGYPRGIGIKNALFVLAGTNFLGTIMTLLVPESKGMSLEVISQEVADGDDEEAAYPK

SEQ ID NO: 785 - DNA, 1821 bp, Oryza sativa
  misc_feature (248)..(248): n = any nucleotide
atggagtccatcgccgccgccacgttcacgccctcgcgcctcgccgcccgccccgccactccggcggcggcggcggccccggttagagcgagggcggcggtagcggcaggagggaggaggaggacgagtaggcgcggcggcgtgaggtgctccgcggggaagccagaggcaagcgcggtgatcaacgggagcgcggcggcgcgggcggcggaggaggacaggaggcgcttcttcgaggcggcggagcntgggagcgggaagggcaacctggtgcccatgtgggagtgcatcgtctccgaccacctcacccccgtgctcgcctaccgctgcctcgtccccgaggacaacatggagacgcccagcttcctcttcgagtccgtcgagcaggggcccgagggcaccaccaacgtcggtcgctatagcatggtgggagcccacccagtgatggaggtcgtggcaaaggagcacaaggtcacaatcatggaccacgagaagggcaaggtgacggagcaggtcgtggatgatcctatgcagatccccaggagcatgatggaaggatggcacccgcagcagatcgatcagctccccgattccttcaccggtggatgggtcgggttcttttcctatgatacagtccgttatgttgaaaagaagaagctgcccttctccggtgctccccaggacgataggaaccttcctgatgttcaccttgggctttatgatgatgttctcgtcttcgacaatgtcgagaagaaagtatatgtcatccattgggtaaatcttgatcggcatgcaaccaccgaggatgcattccaagatggcaagtcccggctgaacctgttgctatctaaagtgcacaattcaaatgtacccaagctttctccaggatttgtaaagttacacactcggcagtttggtacacctttgaacaaatcaaccatgacaagtgatgagtacaagaatgctgttatgcaggctaaggagcatattatggctggtgatattttccagattgttttaagccagaggtttgagaggcgaacatacgccaatccatttgaagtctatcgagctttacgaattgtgaacccaagtccatacatggcatatgtacaggcaagaggctgtgtcctggtagcatctagtccagaaattcttactcgtgtgaggaagggtaaaattattaaccgtccacttgctgggactgttcgaaggggcaagacagagaaggaagatgaaatgcaagagcaacagctactaagtgatgaaaaacagtgtgctgaacatattatgcttgtagatttgggaaggaatgatgttggaaaggtctccaaacctggatctgtgaaggtggagaaattaatgaacattgaacgctactcccatgtcatgcacatcagttccacggtgagtggagagttggatgatcatctccaaagttgggatgccctgcgagccgcgttgcctgttggaacagttagtggagcaccaaaggtgaaagccatggagctgatagacgagctagaggtcacaagacgaggaccatacagtggcggccttggagggatatcatttgacggagacatgcttatcgctcttgcactccgcaccattgtgttctcaacagcgccaagccacaacacgatgtactcatacaaagacaccgagaggcgccgggagtgggtcgctcaccttcaggctggtgctggcattgtcgctgatagcagcccagacgacgagcaacgtgaatgcgagaacaaggcagccgctctggctcgagccatcgatcttgctgaatcagctttcgtagacaaggaatag

SEQ ID NO: 786 - protein, 606 aa, Oryza sativa
  misc_feature (83)..(83): Xaa = any naturally occuring amino acid
MESIAAATFTPSRLAARPATPAAAAAPVRARAAVAAGGRRRTSRRGGVRCSAGKPEASAVINGSAAARAAEEDRRRFFEAAEXGSGKGNLVPMWECIVSDHLTPVLAYRCLVPEDNMETPSFLFESVEQGPEGTTNVGRYSMVGAHPVMEVVAKEHKVTIMDHEKGKVTEQVVDDPMQIPRSMMEGWHPQQIDQLPDSFTGGWVGFFSYDTVRYVEKKKLPFSGAPQDDRNLPDVHLGLYDDVLVFDNVEKKVYVIHWVNLDRHATTEDAFQDGKSRLNLLLSKVHNSNVPKLSPGFVKLHTRQFGTPLNKSTMTSDEYKNAVMQAKEHIMAGDIFQIVLSQRFERRTYANPFEVYRALRIVNPSPYMAYVQARGCVLVASSPEILTRVRKGKIINRPLAGTVRRGKTEKEDEMQEQQLLSDEKQCAEHIMLVDLGRNDVGKVSKPGSVKVEKLMNIERYSHVMHISSTVSGELDDHLQSWDALRAALPVGTVSGAPKVKAMELIDELEVTRRGPYSGGLGGISFDGDMLIALALRTIVFSTAPSHNTMYSYKDTERRREWVAHLQAGAGIVADSSPDDEQRECENKAAALARAIDLAESAFVDKE

SEQ ID NO: 787 - DNA, 1287 bp, Oryza sativa
atggcggccgcgaagcacttcacctacgtcatcctcggcggaggcgtcgccgcgggatacgctgcgcgggagttcgccaagcagggcgtcaagcccggggaactcgccatcatctccaaggaatcggtggctccctacgagcgtcctgctctcagcaagggatacctctttcctcagaatgcagccagacttccgggattccacacctgcgtcgggagcggcggagagaggctcttgcctgaatggtattccgagaaaggtatcgagctgatcctgagcaccgaaattgtcaaggctgatcttgcctccaagacattgaccagttcagctgatgcaacctttacctatgacactttgctcattgccactggctcctcggtcataaagctcactgactttggtgttcaaggagcagaggccaacgacatattgtacctgagggatattgaggacgctgacaagttggtcgcggctatgcaagccaagaaggatggaaaggctgtgattgtcggaggtggctacataggacttgagcttagcgcagccttgaagaccaacaattttgatgtcactatggtgtaccctgaaccttggtgcatgccccgtctcttcacttctggccttgctgctttctacgagggatactacgctaacaaaggaatccatatcataaagggaaccgtggctgttggttttgatgctgatgccaatggagatgttactgcggtgaagctaaagaatggaaacgtgctggaagctgacattgttattgtcggtgtcggtggcaggccactgactcatctcttcaagggtcaagttgcagaggagaagggtggaatcaagactgatgcattcttcgaaacgagcgttcctggtgtatacgccattgccgacgtggccgccttcccgatgaagctatacaatgagattaggagagtagagcatgttgaccatgctcgcaaatcagccgagcaggccgtgaaggcgatcaaggcgaaggaggccggcgagtcggtgcccggagtacgactacctgccctacttctactcccgttctacggcgacaacgtcggcgaggatgtgctgttcggcgacaacgaccccacggcggccaagcccaagttcggctcgtactggatcaaggacggcaaggtcgtcggcgtcttcctcgagggcggctcggcggaggagaatcaggtcattgccaaggtcgccagagctcagccgccggtggccgacgtcgaggctctcaagaaggaaggactcgacttcgctgccaaagtctga

SEQ ID NO: 788 - protein, 428 aa, Oryza sativa
MAAAKHFTYVILGGGVAAGYAAREFAKQGVKPGELAIISKESVAPYERPALSKGYLFPQNAARLPGFHTCVGSGGERLLPEWYSEKGIELILSTEIVKADLASKTLTSSADATFTYDTLLIATGSSVIKLTDFGVQGAEANDILYLRDIEDADKLVAAMQAKKDGKAVIVGGGYIGLELSAALKTNNFDVTMVYPEPWCMPRLFTSGLAAFYEGYYANKGIHIIKGTVAVGFDADANGDVTAVKLKNGNVLEADIVIVGVGGRPLTHLFKGQVAEEKGGIKTDAFFETSVPGVYAIADVAAFPMKLYNEIRRVEHVDHARKSAEQAVKAIKAKEAGESVPGVRLPALLLLPFYGDNVGEDVLFGDNDPTAAKPKFGSYWIKDGKVVGVFLEGGSAEENQVIAKVARAQPPVADVEALKKEGLDFAAKV

SEQ ID NO: 789 - DNA, 915 bp, Oryza sativa
  misc_feature (175)..(175): n = any nucleotide
  misc_feature (594)..(594): n = any nucleotide
atgggagggtttgtcaagacccagaagaccaatgcctaccacaagcgtttccaagtcaagttcaagagacggaggcgtaagtcaagttcaagagaccgaggcgtttccaagtcaagtcaaggttttgacagggcaagactgactacagggccaggattaggctcaccaaccaagnataagaacaagacaaacaaagatatcacagctcaaattgtctatgctaccattgctggtgatatcgtgatggctgctgcctactcccatgagctgcctcgctatggtcttgaagttggtctcaccaactatgcggcagcttattgcactggcttgcttttggctcgccgtgtgctcaagctccgtggtttggaccaggagtacgagggcaatattgaggccactggggaggactactatgttgaaccagctgatgaaaggcggcctttccgtgctctcttggatgttggcctcattaggacaaccactggaaaccgtgtctttggtgccctcaagggagctttggatggtggtcttgacattcctcacagtgacaagaggtttgctgggttcaagaaggacgagaagcagcttgattcngatattcaccgcaagtacatctacggtgggcactctatggcggaggaggaacctgagaaattccaagcccacttcagtgagtacctcaagaagggaattgatgctgatggcatggaagcactgtacaagaaggtccatgctgccatccgtgctgatcctaccatggccaaatcaaccaagaaggaaccggcgacccacaagagatacaacctcaagaagctaacctacgaacagaggaaggccagtcttgtcgaaagattgaatgctctcaactcctctgctggtgctgatgatgatgacgaggaagaggatgatgagtga

SEQ ID NO: 790 - protein, 304 aa, Oryza sativa; identical to SEQ ID NO: 284

SEQ ID NO: 791 - DNA, 336 bp, Oryza sativa
atgaagggacggcaaggccagcgcgtgaggctgtacgtccgcggcaccatcctcggctacaagaggtcgaagtcgaaccagtacgagaacacgtcgctgctgcagatcgagggggtgaacaccaaggaggaggttgggtggtacgccgggaagcgcatcgcctacgtctacaaggccaagacgaagagcaacgactccaccatccgctgcatctggggcaaggtcacccgcccgcacggcaactccggcgtcgtccgcgccaagttccggtccaacctcccgcccacctccatgggcaagaaggtccgcgtcttcatgtaccctagcagcatctaa

SEQ ID NO: 792 - protein, 111 aa, Oryza sativa; identical to SEQ ID NO: 666

SEQ ID NO: 793 - DNA, 615 bp, Oryza sativa
atgggtgcgtacaagtacgtgtcggagctatggaggaggaagcagtcggacgtgatgaggttcgtgcagcgcgtgcggtgctgggagtacaggcagcagccggccatcgtccgcctaacccgccccacccgccccgacaaggcccgccgcctcggctacaaggccaagcagggttatgtggtttaccgtgtccgtgtgaggcgtggtggcaggaagaggccagtgcccaagggtattgtctacggcaagcccaagcaccagggtatcacccagctcaagttccagaggaacaagaggtcagttgctgaggagagagctgggcgcaagttgggcggactcagggtgctcaactcctactgggtgaacgaggactccacctacaagtactttgagatcatccttgtggatgttgctcacagtgctatccgcaatgacccaaggatcaactggctctgcaagcctgtgcacaagcaccgtgagctccgtggtctcacctctgctggcaagaagtaccgtggtctgcgcggcaagggtcacactcaccacaaggccaggccgtcccgcagggctacctggaagcgcaaccagactgtctctcttcgccgttatcgttaa

SEQ ID NO: 794 - protein, 204 aa, Oryza sativa
MGAYKYVSELWRRKQSDVMRFVQRVRCWEYRQQPAIVRLTRPTRPDKARRLGYKAKQGYVVYRVRVRRGGRKRPVPKGIVYGKPKHQGITQLKFQRNKRSVAEERAGRKLGGLRVLNSYWVNEDSTYKYFEIILVDVAHSAIRNDPRINWLCKPVHKHRELRGLTSAGKKYRGLRGKGHTHHKARPSRRATWKRNQTVSLRRYR

SEQ ID NO: 795 - DNA, 1734 bp, Oryza sativa
  misc_feature (90)..(90): n = any nucleotide
  misc_feature (568)..(568): n = any nucleotide
atggcgccgccgccgccgtcgccgccgtgccggccgcgagtcaagcccgagcgcgcccttctgtgcttctccctcctcctcctcctgacngccaccacggcgaacgccagcatcaccgactgcccaactacaagcagcaccaactccagccatgtcgacgacggtgccttcggggccaacctccgcgctctcctctcctccctttccgcagccgcggcggcatcgtcgtcggggttcgccgagaacgcgaccggcgcggcgccggacacggcgtacggcctcgcgcagtgccgcggcggcatcgtcggcggcggcaatggcaccagctgccgctcctgcctcgacgactcggtgcgggacgcggccaaggcgtgccccggcgagaaatccgccgtgatcatctccgactactgcctcgtccggtactccaacgcgagcttcgccggcgccgccgacgagcggacggtgaagctctggtggaacacggacaacgcgacgcagccggagaggttcaagtcgctgctggggacgctgatgggcaacctcaccgacgccggcggcgcgcgcntcatctacggcatggcgcagtgcacccgcgacctcgccgccggcgactgctaccgctgcctcgtcggcgccgtcaacaacatcccgaaatgctgcgacgggaagcagggcgggcaggtcatcacgaggagctgctccatccggttcgaggtgtacccgttcttcgacgcccaggccgccaaggcggccatgtcgcctgcgccggcgccggcgccggtgacgacgcccaccggggtcaatggaagtaatcacacagtcagtaagtctgtgattgtcccagttactgtgggagttgccgtgttactagtggtaatactgctgctaattgccctttgtctgtgcaagaggaacagaaaaccacataagcatatgatgattggaagcgtcgatcttggagatgaagacgaaatgagaggctcagaatctctcttgtatgatttgagtactctaagagcagcaactgccaacttctcagaagaaaataagctcggagaaggtggatttggcccagtctacaaactaatcaacagaatttacatggacaattcagacacttcaagacagcaagaccttaactgggagcaaagattcaagatcattgaagggatcggaagagggcttctttatcttcatgaagattcaaggctcaagatcatccaccgtgatctcaaagctagcaacatcttgttagatgtagacatgaaccccaagatatcagacttcggccttgccaagttatttaacatggaagcgagcgtagcaaacactagcaggattgctggaacctacggatacatggcgccggagtacgcgctgcacggcatcttctcggccaaatccgacgtcttcagctacggcgtgctcctcctcgagatcgtcaccggccgccgcaacacctgcctccatgactccgaggatctcctggcatttgtaatccccgcgcaaatcctatctaaagtctggaggcactggagccgcggcggcgccggggagctgctcgacggctgccccgccgccggccgccggccgcaggagcttctgcggtgcatccacgtggggctcctctgcgtgcaggaggacccgcagctccgccccggcatggcggcagtcgtcgtcatgctcaacagccgctcgagccccggtgacatcggagattcggaggactga

SEQ ID NO: 796 - protein, 577 aa, Oryza sativa
  misc_feature (30)..(30): Xaa = any naturally occuring amino acid
  misc_feature (190)..(190): Xaa = any naturally occuring amino acid
MAPPPPSPPCRPRVKPERALLCFSLLLLLXATTANASITDCPTTSSTNSSHVDDGAFGANLRALLSSLSAAAAASSSGFAENATGAAPDTAYGLAQCRGGIVGGGNGTSCRSCLDDSVRDAAKACPGEKSAVIISDYCLVRYSNASFAGAADERTVKLWWNTDNATQPERFKSLLGTLMGNLTDAGGARXIYGMAQCTRDLAAGDCYRCLVGAVNNIPKCCDGKQGGQVITRSCSIRFEVYPFFDAQAAKAAMSPAPAPAPVTTPTGVNGSNHTVSKSVIVPVTVGVAVLLVVILLLIALCLCKRNRKPHKHMMIGSVDLGDEDEMRGSESLLYDLSTLRAATANFSEENKLGEGGFGPVYKLINRIYMDNSDTSRQQDLNWEQRFKIIEGIGRGLLYLHEDSRLKIIHRDLKASNILLDVDMNPKISDFGLAKLFNMEASVANTSRIAGTYGYMAPEYALHGIFSAKSDVFSYGVLLLEIVTGRRNTCLHDSEDLLAFVIPAQILSKVWRHWSRGGAGELLDGCPAAGRRPQELLRCIHVGLLCVQEDPQLRPGMAAVVVMLNSRSSPGDIGDSED

SEQ ID NO: 797 - DNA, 564 bp, Oryza sativa
  misc_feature (15)..(15): n = any nucleotide
atggcggaccagctntccgaagagcagattggagagttcagggaggccttcagcctcttcgacaaggacggcgacggttctatcaccaccaaggagctaggaaccgtgatgcgaagtctagggcagaacccaacggaggcggagctgcaggacatgatcagcgaggtggacacggacagcaacggcaacatcgaattcaaggagttcctgggcctgatggcgcgcaagctgagggacaaggactccgaggaggagctgaaggaggcattccgcgtcttcgacaaggaccagaacggtttcatctctgccaccgagctccgccacgtgatggccaacatcggggagcggctcaccgacgaggaggtcggcgagatgatcagcgaggccgacgtcgacggcgacgggcagatcaactacgaggagttcgtcaagtgcatgatggccaagaagaggaggaagaggatagaggagaagagggaccacgacggcggcagcaggacgaagagtgcagggccctccgccgcgccggcgagcaagcgtggccagaagtgcgtgatcctgtaa

SEQ ID NO: 798 - protein, 187 aa, Oryza sativa
MADQLSEEQIGEFREAFSLFDKDGDGSITTKELGTVMRSLGQNPTEAELQDMISEVDTDSNGNIEFKEFLGLMARKLRDKDSEEELKEAFRVFDKDQNGFISATELRHVMANIGERLTDEEVGEMISEADVDGDGQINYEEFVKCMMAKKRRKRIEEKRDHDGGSRTKSAGPSAAPASKRGQKCVIL

SEQ ID NO: 799 - DNA, 1317 bp, Oryza sativa
  misc_feature (393)..(393): n = any nucleotide
  misc_feature (421)..(421): n = any nucleotide
  misc_feature (1114)..(1114): n = any nucleotide
atgaggatttccatgggttttgcggcggccgcgctgctgctgctgctgtcgctggcagcggcggacatgtcgatcgtgtcgtacggggagaggagcgaggaggaggcgcggcggctgtacgcggagtggaaggccgagcacggcaagagctacaacgccgtcggcgaggaggagcggcggtacgcggcgttcagggacaacctccggtacatcgacgagcacaacgccgccgccgacgccggggtccactccttccgcctcggcctcaaccgcttcgccgacctcaccaacgaggagtaccgggacacctacctcggcctcaggaacaagccgcggagggagaggaaggtcagcgacaggtacctcgccgccaacaacgaggcgctgccggantccgttgactggaggaccaagggggccntggctgagatcaaggaccagggaggttgcggaagttgctgggctttctcagcaatagcagctgtagaaggcatcaaccagattgttactggcgacctgatatctttgtctgagcaggagctagttgactgtgacacttcatataacgagggatgcaatggaggtctgatggactatgcatttgatttcatcatcaacaatggtggaatcgacaccgaggatgactacccttacaaaggcaaggacgaacggtgtgacgtaaacagggtatctttcgtcttctttgctcccttggtttttcagaaaaacgcaaaggttgtcacaattgacagctacgaagatgtaacaccaaacagtgagacgagtctgcagaaggcggtagcaaaccagcccgtcagtgttgcaattgaagccggtggcagagcattccagctctactcatcgggtatcttcacgggtaaatgtggaacagcactagaccacggcgtcgctgctgttgggtacggcacagagaatggcaaggactactggatcgtgaggaactcgtggggcaagagctggggtgagtccggctacgtccgtatggagcgcaacatcaaggcgagcagtggcaagtgcggcattgccgttgagccatcctaccctctgaagaagggcgagaacccccgaacccgggccctactccgccgtcccnaaccccgcctcccaccgtctgcgacaactactacacttgccccgatagcaccacctgctgctgcatctacgagtatggcaaatactgctacgcctggggctgctgcccactcgagggcgccacctgctgcgatgatcactacagctgctgccctcacgagtaccccatctgcaatgttcagcagggaacctgcctcatggtaa

SEQ ID NO: 800 - protein, 438 aa, Oryza sativa
MRISMGFAAAALLLLLSLAAADMSIVSYGERSEEEARRLYAEWKAEHGKSYNAVGEEERRYAAFRDNLRYIDEHNAAADAGVHSFRLGLNRFADLTNEEYRDTYLGLRNKPRRERKVSDRYLAANNEALPDSVDWRTKGALAEIKDQGGCGSCWAFSAIAAVEGINQIVTGDLISLSEQELVDCDTSYNEGCNGGLMDYAFDFIINNGGIDTEDDYPYKGKDERCDVNRVSFVFFAPLVFQKNAKVVTIDSYEDVTPNSETSLQKAVANQPVSVAIEAGGRAFQLYSSGIFTGKCGTALDHGVAAVGYGTENGKDYWIVRNSWGKSWGESGYVRMERNIKASSGKCGIAVEPSYPLKKGENPRTRALLRRPKPRLPPSATTTTLAPIAPPAAASTSMANTATPGAAAHSRAPPAAMITTAAALTSTPSAMFSREPASW

SEQ ID NO: 801 - DNA, 393 bp, Oryza sativa
atggtgagagtcagtgtcctcaatgacgctctgaaaaccatgtacaatgctgagaagcgtggtaagcgccaagttcttatccggccctcgtcaaaggtgatcatcaagttcctcatcgtcatgcagaagcatggttacattggtgagtttgagtttgttgatgaccaccggtctggcaagatcgtggttgagctgaatggacgccttaacaagtgtggtgtcatcagcccacgctttgatgttggtgtcaaggaaatcgagtcctggactgctaggctgcttccctcccgtcagtttgggtacattgtccttaccacctctgccggaatcatggaccacgaagaagcgaggcggaagaacgtcggaggcaaggtgctcggctttttctactag

SEQ ID NO: 802 - protein, 130 aa, Oryza sativa
MVRVSVLNDALKTMYNAEKRGKRQVLIRPSSKVIIKFLIVMQKHGYIGEFEFVDDHRSGKIVVELNGRLNKCGVISPRFDVGVKEIESWTARLLPSRQFGYIVLTTSAGIMDHEEARRKNVGGKVLGFFY

SEQ ID NO: 803 - DNA, 540 bp, Oryza sativa
  misc_feature (152)..(152): n = any nucleotide
atggagaacgtcaccggaggaggaggaggaggatcgccgcggcgggtggtggtggcggtggacgagagcgaggagagcatgcacgcgctgtcgtggtgcctctccaacgtggtctccgccgccgccaagtcccccgcggccgggccgccgcnggccgtggtcctggtccacgcccggccggcgcggccgctctactacccggtgatcgacggcggcggctacgtgctgacccaggaggtgatggacagcatggaccgctacatggccaccgccgccgactccgtcgtcgccaaggcccgcgacatctgcaccgccttccccaatgtgaaggtggagacgcgggtggagaaaggggacccgagggatgtgatctgcggggcggtggagaaggccggcgcggacatggtggtgatggggagccatggttacggtttcctgcagaggacgctgctggggagcgtcagcaaccactgcgtccagcactgcaagtgccccgtcgtcgtcgtcaagaggcccggcaccaacgccaaggcctcttga

SEQ ID NO: 804 - protein, 179 aa, Oryza sativa
  misc_feature (51)..(51): Xaa = any naturally occuring amino acid
MENVTGGGGGGSPRRVVVAVDESEESMHALSWCLSNVVSAAAKSPAAGPPXAVVLVHARPARPLYYPVIDGGGYVLTQEVMDSMDRYMATAADSVVAKARDICTAFPNVKVETRVEKGDPRDVICGAVEKAGADMVVMGSHGYGFLQRTLLGSVSNHCVQHCKCPVVVVKRPGTNAKAS

SEQ ID NO: 805 - DNA, 381 bp, Oryza sativa
atgtcgtcgatgctgtccgcgttctcgcagtggttcgtgaacccgcgccgcaacccgctcgcccgcctccacatgcaggcgatctcctcgcgcctccggaaatacggcctgaggtacgacgatctgtacgacccgaagcatgatctggacatcaaggaggcgctcgagaggcttcccagggaggtggtcgacgcccgccaccagcgcctcaagcgcgccatggacctctccatgaagcaccagtacctctccgaaaacgaccaggcgcaacagacaccattcagaggctatttgagtgacatgatggatctggtgaagaaggagagattagagcgtgaagaactgggagcccttccccttcaccagaggacccttccctga

SEQ ID NO: 806 - protein, 126 aa, Oryza sativa
MSSMLSAFSQWFVNPRRNPLARLHMQAISSRLRKYGLRYDDLYDPKHDLDIKEALERLPREVVDARHQRLKRAMDLSMKHQYLSENDQAQQTPFRGYLSDMMDLVKKERLEREELGALPLHQRTLP

SEQ ID NO: 807 - DNA, 1203 bp, Oryza sativa
atggcgcggcgatccgcccccctcctccgccgcatcctctcctccccggcccccgccccggcgcaccatggcggcgccggcgcgcgccgcacggtgacctacatgcccaggccaggggacgggaacccgcgcgccgtgacgctgatcccgggggacgggatcgggccgctcgtgacgggggccgtgcagcaggtgatggaggtgatgcacgcgccggtctacttcgagacctacgaggtccgcggcgacatgcccaccgtgccgcccgccgtcatcgagtccatccgccgcaacaaggtgtgcctcaagggcggcctcgccacccccgtcggcggcggggtctcctccctcaacatgcagctccgcaaggagctcgacctctacgcctcgctcgtcaactgctccaacttccccggcctccccaccaggcaccaggacgtcgacatcgtcgtcatcagggagaacaccgagggggagtactcggggctcgagcacgaggtcgtgcccggcgtcgtcgagagcctcaaggtgataacaaagttttgctctgagaggattgccaaatatgcttttgagtatgcttaccttaacaaccgaaagaaagtcacagcagtgcataaagcaaacatcatgaagcttgctgatggtttgttcttggaatcttgccgtgaggttgcctcaaagtatcctggtattcagtataatgagatcattgtcgacaactgctgtatgcaacttgttgcaaagcctgagcaatttgatgtcatgaatgaatgtaatactttctcagaaagacactttcctgaatactggttttcccaaatgattcctgttaagtatccccgtgtaattcctgcagaatttctaactttctactctttggttacaccaaacctttatggcaatttggttgctaacacggctgcaggtaatgtgggtcaggaccatgctgtctttgagcaaggtgcttctgcaggaaacgtcggaaacgagaacatcttagagcagaagaaagcaaaccctattgcgctgcttctatcatccgccatgatgttgaggcatttgcagttcccgtcattcgccgaccggctggagacggcggtgaagcgtgtcattgcggaaggcaagtacagaacaaaggatctaggcggcaccagcaccacccaggaagtcactgatgcagtaatcgccaatctggattag

SEQ ID NO: 808 - protein, 400 aa, Oryza sativa
MARRSAPLLRRILSSPAPAPAHHGGAGARRTVTYMPRPGDGNPRAVTLIPGDGIGPLVTGAVQQVMEVMHAPVYFETYEVRGDMPTVPPAVIESIRRNKVCLKGGLATPVGGGVSSLNMQLRKELDLYASLVNCSNFPGLPTRHQDVDIVVIRENTEGEYSGLEHEVVPGVVESLKVITKFCSERIAKYAFEYAYLNNRKKVTAVHKANIMKLADGLFLESCREVASKYPGIQYNEIIVDNCCMQLVAKPEQFDVMNECNTFSERHFPEYWFSQMIPVKYPRVIPAEFLTFYSLVTPNLYGNLVANTAAGNVGQDHAVFEQGASAGNVGNENILEQKKANPIALLLSSAMMLRHLQFPSFADRLETAVKRVIAEGKYRTKDLGGTSTTQEVTDAVIANLD

SEQ ID NO: 809 - DNA, 1737 bp, Oryza sativa
  misc_feature (375)..(375): n = any nucleotide
atggcgaacgccggtgtcaatgagacggtcgccgtcgccgtcgccattgacgcacctggagttgggcatgaccatggtgccgccggcgaggttcgtcgtccgtcgacgcgccggctggctccggcgggaagcggcgggcggctgatggcggagcttcttggcgtgttcaatggactgacggagcggatgggggaggacgtggcgacctcgtcgtcgtcgcggcttctcttccgcgcgctcaagctggcgcttcccgcgctccgcgacggcggctgcgattgcggcggcggccagtccgtctcccgtgcgctcgtggtcgccgcctccctcgccgacctccagatggacgcggaggtcatctcggctggcatggtnaggggagctctggataccggggcactcgccatggccgacgtcgaggcgcagctcggtgccagcgccgccggtctggtggaagagagcctcaaggtgaagcgcgcgccgtcggaggtcgacgtcgccgacgaggaggccgcgagcgcgctgcggaagcggtgcctctccagctacgacatccgcgccgtcatcctggagctcgccgtcaagctcgacgccatgaagcacctcgacgtcctccccaagcaccagcagcggaccacctcgcttgaggtgctcaaggtgttcgcgctgctggcgcacgccgtcggcgccggcgagctgtcgctggagctcgaggacctctccttccagcgcctgtacccgcaggcctacgcccacatcgaccagtggctgagcagccaagaagacgactgcaagcgcgtcatcgccgcgtccaaggaggagctcctccgcgcgctcaccgccgacgacgagctccgctgcaccgtcaccggcgtcgacgtcatgggccggtacaagagccggttcagcaccatgaagaagctggtgaaggacggccggcggccggaggacgtgaacgacatcctcggcatgcgcgtcatcctggaccctcgccccggcggcggcggctgcgccgacggcgacggcggcgacagggcatgcctgcggacgcacgaggtgatcaaggccatgtggaaggacgtgccggcgaggaccaaggactacatcacgcgtcccaaggggaacgggtaccggagcttgcacgtcgccgtcgacatgagcgagccggggccggaggggaagaagaggccgctgatggagatccaggtgcgcaccagggagatggacatggccgccgtcggcggccaggcgtcgcacgcgctctacaagggcggcctcaccgatcctgaggaggccaagaggctcaaggccatcatgctggcggcggcggaggtggcagctcagcacctccgcgacgagccagccggcgacggtggtcaaacaaccgccgccgcctccgccgccaccgccggcaatgtcgagcgagcgttccagctgctcgacaagaacggcgacgggaggatcagcatggaggagctaaccgagatcatggaggacctcggcgccggcggccatgacgccgaggagctcatgcgcctcctcgacgccaacagcgacggctcgctcagctccgacgagttcgcgctcttccagaaacgggttaagctgaagacgaagttagagaacaaggatgatgagtacaaggagatcctcaagcagaagctgcagaaggttgacgacacggggctcatccacgtctaccgcaagaacctcagcgacaagttggtcctcgtttga

SEQ ID NO: 810 - protein, 578 aa, Oryza sativa; identical to SEQ ID NO: 154

SEQ ID NO: 811 - DNA, 474 bp, Oryza sativa
  misc_feature (21)..(21): n = any nucleotide
atggcgaagctgtacgtgcangcggtgccgccgccggatctgaacaggaacacggagtggttcatgtacccgggcgtctggacgacctacatctgcatcctcttcttctcctggctcctcgtcctctccgtcttcggctgcacgcccggcatggcctggaccgtcgtcaatctcttccacttcgcgatcacataccactttttccattggaagaagggaacaccttttgctgatgaccagggaatgtacaacacattgacttggtgggagcaaatggacaatggcaaacagcttactcgcaacaggaagttccttgttgtagttcctgttgtcctgtatttgatagcttcacacactacagactaccaacatcctatgctcttcctcaacacccttgcagtcgcagtgctcgtggtcgctaaactaccgaacatgcacaaggtccggatttttggaattaatgctgggaactag

SEQ ID NO: 812 - protein, 157 aa, Oryza sativa
  misc_feature (7)..(7): Xaa = any naturally occuring amino acid
MAKLYVXAVPPPDLNRNTEWFMYPGVWTTYICILFFSWLLVLSVFGCTPGMAWTVVNLFHFAITYHFFHWKKGTPFADDQGMYNTLTWWEQMDNGKQLTRNRKFLVVVPVVLYLIASHTTDYQHPMLFLNTLAVAVLVVAKLPNMHKVRIFGINAGN

SEQ ID NO: 813 - DNA, 750 bp, Oryza sativa
atggacgccttctactcgacctcgtcggcgtacggagcggcggcgagcggctggggctacgactcgctgaagaacttccgccagatctcccccgccgtccagtcccacctcaagctcgtttacctgacactatgcgtcgccctggctgcgtcggcggtgggcgcatacctgcacgtcgccttgaacatcggcgggatgttgactatgctcgggtgcgtggggagcatcgcctggttgttctcggtgcctgtctttgaggagaggaagaggtttgggattctcttggccgctgccctgctggaaggggcttcagttgggcctctgatcaagcttgctgtagactttgactcaagcattctcgtaacagcatttgttggaactgccattgcatttgggtgcttcacttgcgctgccatcgttgccaagcgtagggagtacctctaccttggtggtttgctctcttctggcctctccatcctgctctggctgcagtttgccgcatccatctttggccactccaccggcagcttcatgtttgaggtttactttggcctgttgatcttcctggggtacatggtgtatgacacgcaggagatcatcgagagggctcaccacggtgacatggactacatcaagcacgcactcaccctcttcactgacttcgtggccgtccttgtccggatcctcgtcatcatgctcaagaacgcgtctgacaagtcggaggagaagaagaggaagaagaggtcttga

SEQ ID NO: 814 - protein, 249 aa, Oryza sativa
MDAFYSTSSAYGAAASGWGYDSLKNFRQISPAVQSHLKLVYLTLCVALAASAVGAYLHVALNIGGMLTMLGCVGSIAWLFSVPVFEERKRFGILLAAALLEGASVGPLIKLAVDFDSSILVTAFVGTAIAFGCFTCAAIVAKRREYLYLGGLLSSGLSILLWLQFAASIFGHSTGSFMFEVYFGLLIFLGYMVYDTQEIIERAHHGDMDYIKHALTLFTDFVAVLVRILVIMLKNASDKSEEKKRKKRS

SEQ ID NO: 815 - DNA, 660 bp, Oryza sativa
atggcgccgacgtcgaagctgtcgcagggcatcaagcgcgcgtcgcggtcgcacacctaccaccgccgcgggctctgggccatcaaggccaagaacggcggcaccttccccaaggccggcaagcccgccgccgccgccgagcccaagttctaccccgccgacgacgtcaagccccgcgcccccagcacccgcaaggccaaccctaccaagctcaggtcgaccatcacgccggggacggtgctgatcctgctcgccgggaggtacatggggaagcgcgtcgtgttcctcaagcagctcaagtccggcctgctcctcatcaccggaccttttaagatcaatggagtgcccatccgccgtgtgaaccaggcctacgtcattgccacatccacgaaggttgacatctctggtgttaaggtggataagtttgatgacaagtactttgcccgggacaagaaggcaaaggccaagaagaccgagggtgaactttttgagacagagaaggaggcaaccaagaatctgcccgacttcaagaaggatgaccagaaggctgtggatgctgagttgatcaaggctatcgaggttgtcccagacctgaaatcctatcttggtgcccggttctctctcagggacggcgacaagccccatgagatgacattctaa

SEQ ID NO: 816 - protein, 219 aa, Oryza sativa
MAPTSKLSQGIKRASRSHTYHRRGLWAIKAKNGGTFPKAGKPAAAAEPKFYPADDVKPRAPSTRKANPTKLRSTITPGTVLILLAGRYMGKRVVFLKQLKSGLLLITGPFKINGVPIRRVNQAYVIATSTKVDISGVKVDKFDDKYFARDKKAKAKKTEGELFETEKEATKNLPDFKKDDQKAVDAELIKAIEVVPDLKSYLGARFSLRDGDKPHEMTF

SEQ ID NO: 817 - DNA, 1539 bp, Oryza sativa
  misc_feature (7)..(7): n = any nucleotide
atggacntcgcgtcgctgttcccgttcgcgctggcgctggtggcgatcccgatctcgctggcgctgctggaccggctgcggctggggcggatcccgccggggccgcggccgtggccgatggtggggaacctgtggcagatcaagccggtgcggtgccgcggcttcctggagtgggcggagaggtacggcccgatcgtgtcggtgtggttcggctcgtcgctgaacgtggtggtgtcgacgtcggagctcgccaaggaggtgctcaaggagaacgaccagctgctcgccgaccggccgcgcaaccgctccacgcagcgcttcagccgcaacgggatggacctgatctgggcggactacggcccgcactacatcaaggtgcgcaagctctgcaacctcgagctcttcacccccaagcgcctcgaggccctccgccccatccgcgaggacgaggtcaccgccatggtcgagtccgtccaccgcgccgtcacccagccaggtagtgaacataaaccaatcgtagtgaggaatcaccttgctatggtggccttcaacaatataacaaggctagctttcggcaagaggttcatgaatgcaaatggtgacattgatgaacaagggcgtgagtttaagactattgtcaacaatggaatcaagatcggtgcatctctttctgttgctgagtacatttggtatttgaggtggttgtgtccacttaacgaggagctttacaagacccacaacgagagaagggatcggctgaccaagaagatcatagatgagcatgcgaaggccctcaaggagagtggtgccaagcagcactttgtggatgctctgttcactctcagagaacagtatgaccttagtgacgacacagttattgggcttctatgggacatgatcactgctggaatggacaccacagtgatatcagtcgagtgggcaatggcagagctggtcaggaaccccagggtgcagaagaagctgcaggaggagctggaccgcgtcgtcggccgcgaccgcgtcatgtcggagaccgacttccagagcctcccttacctgaacgccgtcgtcaaggagtcgctccggctgcacccgccgacgccgctgatgctcccgcacaaggccagcacgaacgtcaagatcggcgggtacaacatccccaagggcgccaacgtgatggtgaacgtgtgggcgatcgccagggaccccaaggtgtggagcaacccgctggagtacaggccggagcggttcatcgaggagaacatcgacatcaagggcagcgacttcagggtgctccccttcggcgccggccgccgcgtgtgccccggcgcccagctcggcatcaacctcgtcgcctccatgatcgggcacctcctccaccagttcgagtggtctctccccgagggcaccaggccggaggacgtcaacatgatggagtccaacggcgtcgtcacgttcatgagcacgtcgctgcaggtcatcgccaagcccaggctcgacaacccggacctgtacaagaggttccctgtcgagatgtga

SEQ ID NO: 818 - protein, 512 aa, Oryza sativa
MDLASLFPFALALVAIPISLALLDRLRLGRIPPGPRPWPMVGNLWQIKPVRCRGFLEWAERYGPIVSVWFGSSLNVVVSTSELAKEVLKENDQLLADRPRNRSTQRFSRNGMDLIWADYGPHYIKVRKLCNLELFTPKRLEALRPIREDEVTAMVESVHRAVTQPGSEHKPIVVRNHLAMVAFNNITRLAFGKRFMNANGDIDEQGREFKTIVNNGIKIGASLSVAEYIWYLRWLCPLNEELYKTHNERRDRLTKKIIDEHAKALKESGAKQHFVDALFTLREQYDLSDDTVIGLLWDMITAGMDTTVISVEWAMAELVRNPRVQKKLQEELDRVVGRDRVMSETDFQSLPYLNAVVKESLRLHPPTPLMLPHKASTNVKIGGYNIPKGANVMVNVWAIARDPKVWSNPLEYRPERFIEENIDIKGSDFRVLPFGAGRRVCPGAQLGINLVASMIGHLLHQFEWSLPEGTRPEDVNMMESNGVVTFMSTSLQVIAKPRLDNPDLYKRFPVEM

SEQ ID NO: 819 - DNA, 741 bp, Oryza sativa
  misc_feature (246)..(246): n = any nucleotide
atggctatttccaccatccttctcttcctcctcgccggcctcgtcgccgcccacggcgacggcgacaccatgatccgtctcccaagcgacggcgccgaagcaccaccacgcccgcccaaaccctgggactgctgcgacaacatcgagatgtccccgctcgagatcttcccgccgctgtaccgctgcaacgacgaggtgaagcagtgctccgccgcctgcaaggagtgcgtggaggcgcccggcganttcccccgcggcgccttcgtgtgccgcgactggtactcgacggtggacccgggccacatgtgcacggcgccggatcagccgacgacgaagaggccgtggaagtgctgtgacagcatcgtgcagctgccgcagaggatcttcccgccgttctggcgctgcgacgacgagctggagcccggcaagtgcaccgccgcgtgcaagtcgtgcagggaggcgccggggccgttcccggggccgctcatctgcgaggacgtctactggggcgccgacccgggccccttgtgcacgccgcggccatgggggaaatgctgcgacaaggccttctgcaacaagatgaacccgccgacctgccgctgcatggacgaggtgaacaagtgcgccgccgcgtgcaaggattgccagcgtgtggagtcgtcagagccgcctcgctacgtctgcaaggaccgcttcaccggccagcccgggcccatgtgcaaaccccgagcggagaactag

SEQ ID NO: 820 - protein, 246 aa, Oryza sativa
MAISTILLFLLAGLVAAHGDGDTMIRLPSDGAEAPPRPPKPWDCCDNIEMSPLEIFPPLYRCNDEVKQCSAACKECVEAPGEFPRGAFVCRDWYSTVDPGHMCTAPDQPTTKRPWKCCDSIVQLPQRIFPPFWRCDDELEPGKCTAACKSCREAPGPFPGPLICEDVYWGADPGPLCTPRPWGKCCDKAFCNKMNPPTCRCMDEVNKCAAACKDCQRVESSEPPRYVCKDRFTGQPGPMCKPRAEN

SEQ ID NO: 821 - DNA, 1005 bp, Oryza sativa
atggcggcggcggcttcggtggtggtgttgtgcgcgctggtcgtcctcgcggcggcggggggcgcgagcgcttggccggtgatgagcccgtcgtactacgaggcgtcgtgcccaagcgtgtacgacatcgtgcggcgcgtcgtccaggaggcgcgctgcaccgacccgcgcgcccccgccagcctcctccgcctccacttccacgactgcttcgtcaatgggtgtgacgggtcgctgctgctcgacgacttcggcgcgatgcagagcgagaagaacgcgcccccgaacaaagggtcggcgcgtgggttcgacgtggtggacggcatcaaggctgccctggagaacgcctgccccggcgtcgtctcctgcgccgacatcctcgccctcgccgccgagatctccgtcgagctgtcaggagggccgagctggaacgtgatgctggggaggagggacggcacggcggcgaacttcgagggcgccagagacctccccggaccgacggacgatctggacctcctgagacggaaattctccgaattcaacctcgacgacaccgacttcgtcgctctccagggcgcgcacaccatcgggagggcgcagtgcaggttcttccacgaccggctctacaacatcagcggcacggagcagccggaccagacgctggacatggcctacctcaacgagctccggcagagctgcccggcgagcgaccccgaaagcgcggcgctgcgcaacctcgacccgcccacgccggacgcgttcgacaatagctactacggcaacctcctgcgcaaccgcggcctgctccagtccgaccaggggatgctctccgcgccgggcggcgccgcctcgaccaccgcgcccatcgtcgtgtggttcgccggtagccaggacgacttcttcaggagcttcgcgacggcgatggtcaagatgggcaacatcagcccgctcaccgggagcatgggggagatcaggaggaactgcagggtggtcaaccgcggctga

SEQ ID NO: 822 - protein, 334 aa, Oryza sativa
MAAAASVVVLCALVVLAAAGGASAWPVMSPSYYEASCPSVYDIVRRVVQEARCTDPRAPASLLRLHFHDCFVNGCDGSLLLDDFGAMQSEKNAPPNKGSARGFDVVDGIKAALENACPGVVSCADILALAAEISVELSGGPSWNVMLGRRDGTAANFEGARDLPGPTDDLDLLRRKFSEFNLDDTDFVALQGAHTIGRAQCRFFHDRLYNISGTEQPDQTLDMAYLNELRQSCPASDPESAALRNLDPPTPDAFDNSYYGNLLRNRGLLQSDQGMLSAPGGAASTTAPIVVWFAGSQDDFFRSFATAMVKMGNISPLTGSMGEIRRNCRVVNRG

SEQ ID NO: 823 - DNA, 3546 bp, Oryza sativa
  misc_feature (2694)..(2694): n = any nucleotide
  misc_feature (2708)..(2708): n = any nucleotide
  misc_feature (3084)..(3084): n = any nucleotide
atggacgagtcaggcagaggaacaggtgatgatcatggccgggagacgaaggatgctgcggcggcggcgtcgtcgtcgtcggggaagaaggtgccgctgttcagcttgttccggtacgccgaccgcctcgacgtgctgctgatggttgtcggcacggtgggcgcgctcggcaacggcatctcgcagcccctcatgacggtcctcttcggcaacgtcatcaactccttcggcgcgaacaccagcggcagcgtcctccgcagcgtgaccaaggttgtcctcaacttcatatatctgggaattggaacttcagtagcttcctttcttcaggtatcatgctggactatggcaggagaaaggcagtctgcccgcatccgttctttatacctgaaagccgttctgaggcaggatattacattcttcgacacagagatgacaactggtgaagcagtttctagaatgtctagtgataccctcctaattcaaggtgctcttggtgagaaggcaggagggaagcttgtagaactgttatcaagcttcatcggtggctttatcatagcattcactagaggatggcttctcactcttgtcatgctaacatcgctaccgttaattgctattgccagtgcagtttctgcacaggccctaactagagtttctagcaagagacaaacatcatatagtgatgctggggacacagttgaacagaccattggatctataagaacagttgtgtccttcaatggtgagaagaaagcgatagcaatgtaccgtaattttataaagaagtcatacaaggctactattgaggaaggcattatcactggttttggcatgggctctgtcatgtgcgtcgtatttggcagctatggattagccttctggtatggtggaaagctaatcattgagaaaggttacacaggaggaaaaatcatgactatcttgtttgccgtgttgaccggtgcatcctcattaggcaatgcaacacctgcagttgctgcagttgtggaaggtcaatctgcagcatacaatttgttcaaaacaattgagaggaaaccagagatagattccgatgataacaatggcatggttttagaagatatgaatggcgatattgagctaaaggatgtgtactttcgttaccctgcaagaccagagcagttgatattggatggattgtcgttacaagtagcgagtggaacaacaatggctatagtcggagagagtggaagcggaaagtcaactgttatcagcctagtcgaaagattctacgatccacagtctggcgaagttttaatagatggaattagcatcaagaaactgagacttgattggataagagggaagatcggtcttgttagccaagagcctctgctttttatggcctccattaaagataacataatatatggtaaaaaagatgcaacgcttgaagagatcaagagagcagcggagcttgcaaatgcagctaacttcattgacaagttaccaaatggttatgatactttagttggccagcgcggtactcagctctctggaggacaaaaacagagaattgcaattgcaagagccatcctcaaagatccaaaaatccttttgctcgatgaagcaacaagtgcacttgatgtggagtctgagaggatagttcaggaggcactaaatagaatgatggtagaaagaaccacactcgttgtcgctcatcgtttgagcactgtgaggaatgttgattgcatcacagtcgtccgcaaaggaaaaatagttgaacaaggtcctcatgatgcactggtgaaggatcccgatggagcttactcccagctaattaggctacaagagactcatcgtgatgaaaggcataaactaccagattccagatcaaaaagtactagtttgtcattcagacgatcaagaactaaagattttctcagcaagagcaacaggtattccttcaagagccccttaggattgcctgttgatatacatgaggatggaatgacaagcgaacaacaaaaggttgaccactctgacacagaatattttttgtttggaattgctgggggaaagcttatacagcgtgtccgtacactgtcatttcaaagaattatgcaccaagaggttgcttggtttgataagccctccaattccagtggggcacttggtacaaggctctcagtcgatgcgttgaatgtccgccgtttagtaggagataacctggcccttatagtccaggctgtagctacactaatcactggctttgccatagcttttgcggcagattggaggcttgcactgatcatcacttgtgtaattcctttagtgggtgcacagggctatgctcaagttaagttcttgaaggggttcagtgaagaatctaaggagatgtatgaggatgcaaaccaagttgcggctgacgctgtaggcagcatcagaactgtagcatctttctgttcagagaaaagagtggtggcaatatacaacaagaaatgtgaagctttaagaaaacagggaattcgaagcggaatcgttggagggattggcttaagtttctcaaacttgatgttatatctgacttacggtctttgcttctatgttggtgcaaagttcgtaagtcagggaaaaactactttttcagatgttttcaaagttttctttgctttagttttggcagccgttggtgtttcgcagtcaagtgcattgtcnactaatgcaacaanggcaagggattctgccatttccatttttagtattatcgatcggaagtctaggattgattcaagtagcgacgagggagcgataatggaaaacgtcactggcagcattgatttcaataatgtcagtttcaagtacccatcacgccctgatgttcaaatattcagtgactttaccttgcacattccttcccaaaagaccatagcacttgttggagaaagcggtagtgggaagtccacgataattgctttattagagcgtttctatgatcctgattctggtaatatctcactagatggagttgaaattagaagcttaaaagtcagctggttgagggatcagatggggcttgtaggccaggagccagtgcttttcaacganacaatccgtgccaacataacatacgggaaacacagtgaggtaacagaggaagagatcactgctgtggccaaggcagcaaacgcccatgagttcgtatcaagcctgccacaaggatacgacacagtggtaggtgagaaaggggtgcaactatctggtgggcaaaaacagagggtagcaattgcaagggccatcctaaaggaccctaagatactgctacttgatgaggcaaccagtgctctagatgcagaatcagaacgtgttgttcaagatgcattggatcgagtcatggtcaacaggactaccattgtagtggcacaccgcctctccacaatcaaaggggctgatatgattgcagtcctcaaggaaggaaaaattgcagaaaaaggaaagcatgaagcactattgcggatcaaggatggtgcatatgcttcacttgtacaactccgctctaattccgagtaa

SEQ ID NO: 824 - protein, 1181 aa, Oryza sativa
MDESGRGTGDDHGRETKDAAAAASSSSGKKVPLFSLFRYADRLDVLLMVVGTVGALGNGISQPLMTVLFGNVINSFGANTSGSVLRSVTKVVLNFIYLGIGTSVASFLQVSCWTMAGERQSARIRSLYLKAVLRQDITFFDTEMTTGEAVSRMSSDTLLIQGALGEKAGGKLVELLSSFIGGFIIAFTRGWLLTLVMLTSLPLIAIASAVSAQALTRVSSKRQTSYSDAGDTVEQTIGSIRTVVSFNGEKKAIAMYRNFIKKSYKATIEEGIITGFGMGSVMCVVFGSYGLAFWYGGKLIIEKGYTGGKIMTILFAVLTGASSLGNATPAVAAVVEGQSAAYNLFKTIERKPEIDSDDNNGMVLEDMNGDIELKDVYFRYPARPEQLILDGLSLQVASGTTMAIVGESGSGKSTVISLVERFYDPQSGEVLIDGISIKKLRLDWIRGKIGLVSQEPLLFMASIKDNIIYGKKDATLEEIKRAAELANAANFIDKLPNGYDTLVGQRGTQLSGGQKQRIAIARAILKDPKILLLDEATSALDVESERIVQEALNRMMVERTTLVVAHRLSTVRNVDCITVVRKGKIVEQGPHDALVKDPDGAYSQLIRLQETHRDERHKLPDSRSKSTSLSFRRSRTKDFLSKSNRYSFKSPLGLPVDIHEDGMTSEQQKVDHSDTEYFLFGIAGGKLIQRVRTLSFQRIMHQEVAWFDKPSNSSGALGTRLSVDALNVRRLVGDNLALIVQAVATLITGFAIAFAADWRLALIITCVIPLVGAQGYAQVKFLKGFSEESKEMYEDANQVAADAVGSIRTVASFCSEKRVVAIYNKKCEALRKQGIRSGIVGGIGLSFSNLMLYLTYGLCFYVGAKFVSQGKTTFSDVFKVFFALVLAAVGVSQSSALSTNATTARDSAISIFSIIDRKSRIDSSSDEGAIMENVTGSIDFNNVSFKYPSRPDVQIFSDFTLHIPSQKTIALVGESGSGKSTIIALLERFYDPDSGNISLDGVEIRSLKVSWLRDQMGLVGQEPVLFNETIRANITYGKHSEVTEEEITAVAKAANAHEFVSSLPQGYDTVVGEKGVQLSGGQKQRVAIARAILKDPKILLLDEATSALDAESERVVQDALDRVMVNRTTIVVAHRLSTIKGADMIAVLKEGKIAEKGKHEALLRIKDGAYASLVQLRSNSE

SEQ ID NO: 825 - DNA, 1539 bp, Oryza sativa
atggcagaagcaatcttctcggcaattgttggcgatgtgatcggcagagtgatatcccttgttgtcagtaatttcaatggagatcacagcactgaagtcaagttacagaggatatgccgcatgctgatcaagatccatagcgtagttgaggaggccaaagggaggcagatcaccaaccatggcaccctcgagtggctctcggagctcatcgatggcgcataccaaggccgttacttgctcgacacgatcggatgcggggagcctgatcttgatgacaagaatcgcgatgaggtagatcccaagcctttctccttgtccaagttcaatcctgcaaagcgtgtgcgcgtcgcggctttcaccgtgaggaacatactgtctcgccacgacatcggtgttgatgagattgatagggtggttgagagcttgcagagcatgtgtggtgatctcaaggagttcatgatgctccttcaggcctgccagccgattcatcggcctctagctaccaacatcttcatcgaggggcagatgttcggccgacatgtcaaaaaggagatgatcatcaacttcttgctgcatgaggatgatctaccaagaggaaaacttggtgttcttccgattctaggcgatatcggggtcgggaagaccaccctagtacagcatgcctgtgatgatgctagggtgcgcagccacttcacaacaatcttgctgttcaatttctcacacacctacaagatggagatgtgtgaaccaaagcctgttctacggcctaaacatgtcatcggagatgttggaaattcagatgatccactacatgaactggagcagagtttcttcaacaagaggttcttgattgttttcgaggatgttgacatacacaagaagaacatgcttgaggagctcctgaaaagcctgagttgtggcaaacaaggtagcaagatcatagtcacaaccagcaacaagcatgtcactacaattggaacagtgcagcctatcaaactgaagtttttgccctgcccagagtactggttcttcttcaaagcgcatgccttcgccggcacagatgtccaggagaaccctaggctggtggcagcaggaaaatcgatcgccgcgaagctgaacggatcattcttcggcgcaaagatcatcggggcgattctgaaagaaaatccagatcctaaattctggtgtacggttcttcagagagatattggggggctgtcattgttgggtgatggacttggctacattgctgatttagtggaaattttgctgccaagtcgcctatccgtgaaggaggtcttcgtctccaagaactcattgtcctctgagacagagttggctaggctgcagggtctgtgcttgccatgtcctagctctgcccctctagccactcatagcagtgagctcagcttagcaaaagcaaccagctatgaaagagtgttgctgtgcaaggcagtgttgccattctactccttgtactacactgctaagtgtgctgtggactctgagaactgttactcaaagtttagtgttgtttag

SEQ ID NO: 826 - protein, 512 aa, Oryza sativa
MAEAIFSAIVGDVIGRVISLVVSNFNGDHSTEVKLQRICRMLIKIHSVVEEAKGRQITNHGTLEWLSELIDGAYQGRYLLDTIGCGEPDLDDKNRDEVDPKPFSLSKFNPAKRVRVAAFTVRNILSRHDIGVDEIDRVVESLQSMCGDLKEFMMLLQACQPIHRPLATNIFIEGQMFGRHVKKEMIINFLLHEDDLPRGKLGVLPILGDIGVGKTTLVQHACDDARVRSHFTTILLFNFSHTYKMEMCEPKPVLRPKHVIGDVGNSDDPLHELEQSFFNKRFLIVFEDVDIHKKNMLEELLKSLSCGKQGSKIIVTTSNKHVTTIGTVQPIKLKFLPCPEYWFFFKAHAFAGTDVQENPRLVAAGKSIAAKLNGSFFGAKIIGAILKENPDPKFWCTVLQRDIGGLSLLGDGLGYIADLVEILLPSRLSVKEVFVSKNSLSSETELARLQGLCLPCPSSAPLATHSSELSLAKATSYERVLLCKAVLPFYSLYYTAKCAVDSENCYSKFSVV

SEQ ID NO: 827 - DNA, 726 bp, Musa acuminata
  misc_feature (181)..(199): n = any nucleotide
  misc_feature (466)..(466): n = any nucleotide
tggattcctctttagttaccacccccttcaatatctacactcacatatcacgttactaaactgcaatgcaactacaaccttttcctatctattatacacacacaacctctgtaatgggcctaacaccagctatatatcactaccatacatgtgcttcctaggaaccatgaattggtgtctnnnnnnnnnnnnnnnnnnngtgatactgtttcgatcgagcctactatggtgacaaatatatgatgatgatactacttcatggtatctaatagtgatgggggactgggcttagaaccccagtaggagggttccgaaggggctctgtgggggacgcctttccttctcttagcggtgcggaagctggcggcggtcggcggcggcgtcgatggtgtgaagctgtgtgtcacgtttctcctctcgtaaccggggctgctgcttctcaagtaagactcctccgagtctgatncggccgttgacttcttcttgttcttcgtctttttcttcttgcggcagtcggaggaagtaccggtgatcttgcagccgagggagcagaagcggaaggagtcgaggaggctccgattgcagacttcgcaggtgttggtgacgcccttgccgggcctcggctgtgggcgcttgttgaggaagacgacacgggcactgttgatgatgtacgtctgcacgccggtgatgtcagtacttctggatctcgaaatctgatcacgtcgt

SEQ ID NO: 828 - DNA, 593 bp, Musa acuminata
aatgattactcgacaattgcagatatcaactacagaatccatttccaatttacaagatagggtagaaacagaactaagcaactcatcgcaacgtaatcatccacttatatactacagaacgaagcttggatctatgagtacatatagcttctacagatggttaaatagcacgtctcctgaattctattactggtacaataacgctcccttcaaatggcataaattctgtcaatctcagaatcagatatctccgagttatgttgccatgagtttgaaccgctccttgattttgtcctcttcctcatagcacggctgtgcttcgatttaaccacatagaaagtcatggtcccaagaacaccagtcattattaggccacctatcagtgtaaccagaatagctgcccatcggatatgccggcccaacacaatgaatgaagatgcgataaaagcaacggtagtgcagacagaagccaaccacatcagcttgttaattatctgaatgacccgcctctctgcctttgtttctcccctgacaagtgttatctgaaccaccaccactgctaatgaagtgaacagggcatagcattgaaaatg

SEQ ID NO: 829 - DNA, 670 bp, Musa acuminata
  misc_feature (11)..(11): n = any nucleotide
tgcttgataanttgcatatggttctaagataaattttaacaggattttgtagaaacaaactgcagttagaggccacagaagagaggactcgtgcaataagaacactgaaaacaaccacagcacataggtaaaacttgcagcacacagttcgattactaatataaactcgttgatcgagtacttttaatttggaaaatataacgtgccagatttaagagaaaacctcctaataacctcaacttctgatgagcaaaattaatcttcctcctcgccttcattctcagcaatgttgaagtatctgagttcgtagacagtgcgatctttgtttgaagcaataactcgcaaccaatcccgcacattgtgtttctttaagtacttctttgtcaagtatttcaagtaccgcttggagaacgggccctccgaggtgacggtgatcttgctcttgtcccgggtgacggtcacggcgtcgccaagggcgccggccttgccgccagcgaccttgatccgctcctggaggaacttctccagcgaggcgatgtccatgatcttgtcctccaccggcttcgcgcagtcgatcacgaaggtcgagcccttcttcttcccccccttcgccgccgccgctgcgcttcccccgcgactcatcgtggtttcctctgctctcgctacagac

SEQ ID NO: 830 - DNA, 571 bp, Musa acuminata
  misc_feature (4)..(4): n = any nucleotide
  misc_feature (9)..(9): n = any nucleotide
  misc_feature (44)..(44): n = any nucleotide
tganttttntcccaacttacacaacattaattggctaaaacagnactcagttcgtcatctttataaacaaggaaatcaaacatgcagatctaatttcagactacagttgaccaagcaatcttttggccaattctccgtaatcaatagctttcttcaatggatgtgtacattcacatattttgaagctgcaacatcttcagcatccaattgattatatcacctccaacttcatcgcgctcaggttcaaatagaaggtcgtgtaagaagccttcatagagctttatatccttgtgtctcgaggcagcaacattgtacagatcttgcgacgccaatggatcagtgaccctgtcagcagtcccatgcagtacgaagaaaggtacagtgatggacttcatattctgcagcaggtaagaagagatgcgtaggatctcatggcctgtgcgaactcttataggtctagtgtaaaccagtggatctgagtacttagccgacatagcagctgggtctcttgacacaggaatgccccttatattagctcccttgaattgggaactttgggcagtaccagtga

SEQ ID NO: 831 - DNA, 657 bp, Musa acuminata
  misc_feature (16)..(16): n = any nucleotide
  misc_feature (440)..(440): n = any nucleotide
  misc_feature (618)..(618): n = any nucleotide
  misc_feature (631)..(631): n = any nucleotide
aataaatcatgacaantcatctaatttgataaaagtgcaaaagaaagttgattattgagcccatcaaataaccacagaaccatgccaagctcaataaacataatctcacagaataacaactcaaaaacagattcagccatagaaagtctgaataaatccatccattttttgtgattgcgctcaatgtgacttcacatactcctgaactatatgaaggccctctgattcttctccgtaatccttgaggacgacacatgaacaacccacaacttttctagcctttccttctgaatcaatcttacacagccctgcccactccccaagtgttttggcgcttggtacggtcactaaatgcacattgtgatcagcacatagtgctttgaccagcttgacatagtcagcctggttgcagtcctcagctaggatgcaaagttgcgcanatgcttctcgattgccttcgcagcttcatgaagtccacgaacaagcccatcatggggccaacgatttcttcatcacaagctgcagagctgtcatcaagtccatgggctctccaagagctggggcattctcagccgtgacagcaacttcagcagccatcttcttgtgcgtgtacggatngggagaaggaaancctacgattcagagacaccttactct

SEQ ID NO: 832 - DNA, 675 bp, Musa acuminata
  misc_feature (97)..(115): n = any nucleotide
  misc_feature (484)..(484): n = any nucleotide
  misc_feature (571)..(571): n = any nucleotide
  misc_feature (577)..(577): n = any nucleotide
  misc_feature (580)..(580): n = any nucleotide
  misc_feature (587)..(587): n = any nucleotide
  misc_feature (601)..(601): n = any nucleotide
  misc_feature (611)..(611): n = any nucleotide
  misc_feature (619)..(619): n = any nucleotide
  misc_feature (652)..(652): n = any nucleotide
  misc_feature (656)..(656): n = any nucleotide
  misc_feature (670)..(671): n = any nucleotide
agtggattggacatagtggctgccaacgattagatcaaggttttgatccggagaacatattcatgtgcagcctctcgctttgatgcttcagacacannnnnnnnnnnnnnnnnnntctttacacgcagcacgaagttgcagacagagaagaaaacatggctatggggattaactatatctaaactgttctgtatcttttctgagacacaacaacgaacacctgtcatatggcgtcggatttgggcttcccgttgctcatctccgtctccgccttgcccacatggacgtcctcgtccgcgatgaacttgctccagaaccagtgggacctccagaccaggatcatctcctcgatgggcacgttcttggtctcgggcaggaagatggagatgaaggtggtcatgatgagcacccacccggcgaagaagtagaagaggccaaacttcatgtggcagagcatggtgaggaaagcctgcgcgatggcganggtgaagaacatgttgacggacacgttgatgctctgccccgccgaccggatctccagtggaaatatctcgctaggaaccaaccagcncagggntcnccatgancaggcgaacccggngacgtagatncagatgcngagcaccacgaatgccgcgtaagccttggacangtgnccctctccgttggnnccga

SEQ ID NO: 833 - DNA, 589 bp, Musa acuminata
tgaataatgatttcttaatagggaaatataatgcctgaaaatttggaaaatattgccctcaccatcatctaataatggcagccgaatgacaataaccagtttggaaacacaaaacagcataagggatagacattattatcattctgaaaaataaaaggtaggatcgatgactggcatagtttgctgcggcaaaaccaccagggaggttcacttaaaatcaggcttctctgggtaagtgcagcctgacctctgaattatcacatttgcggcataacaaccggctcttacgcagtcctcgatgctcttttcttgaaccaactgggacaagaatcctccaacaaatgcatcacctgcaccattggtatcaaccagcttctcctttggcaataggatcactgggaacaatctcacctttccatcctcagcgacaactactggatcacaaccttgagtgataacagtaattcttttgtgagttcctgatgcctttggcaatgctgagatctttaaagcaatctcctcaacattctcagtctcccaaccgcgaactcttgcaaaggtccttgcttcagtttcattcccaaataca

SEQ ID NO: 834 - DNA, 496 bp, Musa acuminata
atcgtatgaagcaattggacacagagtgccaatcaagaggacagttctattcaattacccacgctaaaataaacttcaacaagaaatgcaataagacgccattcaaaaccctaacttcatgttaagatctcaaccttcaccaaatcatccttaagcgttgccgagaaaaaggtgcagagcaagagtcaatctcccttccgccggaaggagcagccctcggtgagcctggcgcgccccccggtcggctggcagaggacggtctggcagttgccgcatacaaccacggtctgcgagtggctgaacacagtagttatgttgaagcagccttggcacttcacatccatgaagaaggagttgggggactgcacgaggcgcttgagcttgtgcctcctcttctcgagctcggccggagggttcagcagatcgacatcgttcggtagcaccatcttggtggaaaccttaggactcttcgaaagcgaggaagtccagtaagcgg

SEQ ID NO: 835 - DNA, 567 bp, Musa acuminata
  misc_feature (2)..(2): n = any nucleotide
  misc_feature (11)..(11): n = any nucleotide
anctcaaagcnttaaaaagacttgaaagctctggaaaataaagatcattactagtaaattaaaaatgttgaaaatgagggacgttggtctcagttatattctctgctgtaactactttgtccagtgggctcttgcaatgtttctgcagttcaatatatctctgaatgtcaaaactatgcttctgaaatagtttcttttgtcttgacaagaacagcctcttcataaagtcttggtatgtcggatctctcgatgtaaaaaggaagtaggcatatccacaaagaatgccagctgtagtggcgaagaaggctattggctccatgacatcccatgagaactcccagaatgtaagccgaaagaagagaccaatctgaacgattaggaatcccaaccctaaccaaagtatgcgacggacttgcttgtgagcaagcatatcgatttcttgtttcttctcctgcagctgcttcaactcttctctccttgggtcattctcagggtgtcaaagaaagagggacagcccttcttataagatccacaaccttttccgggtggagatataccttatcccta

SEQ ID NO: 836 - DNA, 599 bp, Musa acuminata
cttcagattcactttcacgagagttcctcacaccggaagcacactcttattgtgacatattcgatactgcctcactgaccaaaccaaacccacatcgaatccccgagctcagatggagacgctgttggggattccccgtccggtgagcccgccgacgccggtcaagtcggagacgttggggtagagcagcgtgtagggcatcttaaccgggccggtgcgattcctcaggctcgcgtcctggttcatgcttatgatccgattctcgatctcgatcaacttatggctaaatcgctcgaacgcctcgagcgcgctgcggtccgtggtccactccggcgagtccctttgcccaaggtacacctcgtcggaggagtggcgcgacaggacctcgatgagtgacacgccgaggatggtctggaactggctggtgatggtcttcaggaacgctaggtccgggttcttctccagctcgtggtactccggcgtgcccggctcgggcatgaaccgccgactgatggtgggccggttggggaggtagccagcgtaggggtactgcccgaagttgaccgccgcgtgcagggcggaggcacccagatgatggt

SEQ ID NO: 837 - DNA, 656 bp, Musa acuminata
ttcttcacattgctgggcaacacaaatttcacaatccacaaactcggtactttccttcacatattacatgccttgggtaaagaatttaataaattataaggaaaacaaagaagttaaagcaagtgctagttgccaatttactatttattcttcataacattcaccatagtgaattaaccatccacaaacttggcatgtcatggaaaatcaagtcgtaacaaaatcagactcaggtatcatcaacctgtgaatgaaagacaaaacttgggaaggtagttgtaatgtccttgaggtattgaagggtcatgttcttcaacaaagaaggatgcctcaagacaagactgcgccactcttccttatcaattcttccatcatgttttgtatcagcttcctgaaatgtcttatcaatgatactctcgataacttcatctgacaaattcatgcctgactcagcaagagtagccacgaccatttgcttaacctcttgtctttcaataaatccttgctgcttcagatcatatagttggaatgagaccgatcagcaaataagctctccttcttgttagtcttgaacaaagccaattgaaactcttccttgttgatcaagccgtcatcaattacagcactgctgatcttttgaatagcctcgtatagtg

SEQ ID NO: 838 - DNA, 728 bp, Musa acuminata
  misc_feature (4)..(5): n = any nucleotide
  misc_feature (18)..(18): n = any nucleotide
  misc_feature (26)..(26): n = any nucleotide
  misc_feature (700)..(700): n = any nucleotide
  misc_feature (714)..(714): n = any nucleotide
taanntgcaatgtgtcanatcagtancagaaataaaatatagtgatgatgaccatgatgataaaaagacgagattgaagacttggacaacgagttgggagtcggtttaagcaacatgataatacaataaaccattcagttgggacttcaacccacctcaaattcctaactactagtctttctgcatgccaaaaggcaaaatcatcatgataatacaataaaccattcagttgggacttcaacccacctcaaattcctaactactagtctttctgcatgccaaaaggcaaaatcatcattggggattagcgtagaacgactctgagggcgaagttaacgatgaagactatttttactctcccggtgcagagaccccttgcttgagcttttccctcttcaacttcttttttgagactggcttcttcttctttggcggaagggtcttctgtgcatacatatagagaacatagttcccgccgaggaagagcagcagaaggccccccacaacaagcaggacccccaaccctgggttcaaccctttagctgcttgctccctgatcacatttccagctgcatccgagtactgttcatccatggcgacggatctcaccaaaatcccgtcccttttccagtcgaagaactcgttagacatcgtgtagattacgatccgagtggatctgcggggtacgaatcgaggaagnttgcacgaatccgngagaagatgaacga

SEQ ID NO: 839 - DNA, 447 bp, Musa acuminata
  misc_feature (15)..(15): n = any nucleotide
  misc_feature (17)..(17): n = any nucleotide
  misc_feature (34)..(35): n = any nucleotide
  misc_feature (37)..(37): n = any nucleotide
  misc_feature (43)..(43): n = any nucleotide
  misc_feature (293)..(293): n = any nucleotide
  misc_feature (299)..(299): n = any nucleotide
  misc_feature (306)..(306): n = any nucleotide
  misc_feature (309)..(309): n = any nucleotide
  misc_feature (313)..(313): n = any nucleotide
  misc_feature (336)..(336): n = any nucleotide
  misc_feature (345)..(345): n = any nucleotide
  misc_feature (378)..(378): n = any nucleotide
  misc_feature (411)..(411): n = any nucleotide
  misc_feature (413)..(413): n = any nucleotide
  misc_feature (421)..(421): n = any nucleotide
  misc_feature (427)..(427): n = any nucleotide
  misc_feature (439)..(439): n = any nucleotide
aacttgtaagcatgntncagcttcttaaacacanngntcaaancacagcaatctactaagaaaaagcttaccctatcacaagatagcgagtaatacacatgatcgaataggatgcttcagagatggggtctaacatgaagatagcaatccttgttcctcgtgcaaggatcatctacatagcaatcgatgccatcagacttatttatgacccatattccgccggcgaactatctacctgtcgacaacgagcagcaatttagtggtaaccgagcggtgccggtgaatctttgagntccaanccctggnaanggangtccgaagcgaagtgattgacgncacgatggngcgcctcgtccgcgcggacgaccacgaccacanccttgagagtggcgtcggcggggagacgccagnantcgaattnatgganggggcggggacnttgtcgat

SEQ ID NO: 840 - DNA, 540 bp, Musa acuminata
  misc_feature (4)..(4): n = any nucleotide
  misc_feature (9)..(10): n = any nucleotide
  misc_feature (470)..(470): n = any nucleotide
tcanagagnnggtacaagcacctgtttgcaggcattatccctaacagaagcaatggccaaaagacatttgccatggggccacaagcagcacaacatcgatacaacttcaagagtgtcacaaaaagcagctcgagagaaccatcaatgaatataaatcaacaaaatgttcataacattttcctcaaacgcaagtaatacttgacccgaacacttccatctttcctggttgcagtttctacatcctatggttgcaacgttaaatccttggccgctgtattgacctgcctagtgaggtagtcttcataaatctccaccacaagccgtgggtccttctccacaagttccttgtactcttcgcgttctgtcagtgtggccatgttgtccattatcagtgacaaggaggcctcgagcagttgattggcgttatgccgatggggcgaaggcattaacttgcaacggcattctcactngttcactttggatgtcatgaacttctcacagaaggatcttcagatgcttcacttggtatttctcagccaa

SEQ ID NO: 841 - DNA, 500 bp, Musa acuminata
  misc_feature (13)..(13): n = any nucleotide
  misc_feature (32)..(32): n = any nucleotide
  misc_feature (41)..(41): n = any nucleotide
  misc_feature (56)..(56): n = any nucleotide
  misc_feature (59)..(60): n = any nucleotide
  misc_feature (71)..(71): n = any nucleotide
  misc_feature (75)..(76): n = any nucleotide
  misc_feature (78)..(79): n = any nucleotide
  misc_feature (81)..(81): n = any nucleotide
  misc_feature (85)..(85): n = any nucleotide
  misc_feature (87)..(87): n = any nucleotide
  misc_feature (120)..(120): n = any nucleotide
  misc_feature (125)..(125): n = any nucleotide
  misc_feature (129)..(129): n = any nucleotide
  misc_feature (156)..(156): n = any nucleotide
  misc_feature (171)..(171): n = any nucleotide
  misc_feature (177)..(177): n = any nucleotide
  misc_feature (180)..(180): n = any nucleotide
  misc_feature (202)..(202): n = any nucleotide
  misc_feature (206)..(206): n = any nucleotide
  misc_feature (312)..(313): n = any nucleotide
  misc_feature (364)..(364): n = any nucleotide
  misc_feature (372)..(372): n = any nucleotide
  misc_feature (386)..(386): n = any nucleotide
  misc_feature (425)..(425): n = any nucleotide
  misc_feature (445)..(445): n = any nucleotide
  misc_feature (454)..(454): n = any nucleotide
  misc_feature (497)..(498): n = any nucleotide
atatctcctggcngtagcatgcttcaaaaatnctagatttngcatatccatatttntcnnagtttctcatntatnntnntnatantnataatgcatcactgatccaaactagcacttganttgcntgantgcacaatcctcggctcttcacccttncggtttgttctctcngtcgangantagtgctcctcacagtaacagnactngcagtgttcaatgtgtaagcaccgcctgctttgaccttcccacaatccttgcagccccaaatcccaactgcttttcttttcacggccatacttcccacagaattcnnagaagtactttgcatgctgagaaacttccattttcttgatttgcttccgcnaacttgcnccatatctggtacntatttgcccactattccagccttcttggtgcgttcgtcntcgttaagcgtacgaacgtngggtcctgnccttgttccgacggtctaaacgccgagggagagaactccagannag

SEQ ID NO: 842 - DNA, 346 bp, Musa acuminata
acccagagatgcagcagtgtcggtgatgcaggaggtgcggctgatagggttctcaatcagctgctgacagagatggatggcatgaacgcaaagaaaactgtctttattatcggggcaaccaacaggcctgacatcatagatcctgctttacttcgcccaggccgtctggaccaattgatttatattcctttaccagacgaggcctctcgtcaccaaatattcaaagcttgcctgagaaagtctcctctctctttcaatatccttttcaatgttttctctaatggcatacttgcatgcacgttggcaaatttctgtaatatcggcaccactaaatccttgagtgtac

SEQ ID NO: 843 - DNA, 604 bp, Musa acuminata
  misc_feature (2)..(2): n = any nucleotide
  misc_feature (20)..(20): n = any nucleotide
  misc_feature (556)..(556): n = any nucleotide
  misc_feature (580)..(580): n = any nucleotide
tnaccttatcttatccaaanaattattcggtcaatctcttctgattccaatcgatcaacctaatctggccgatcaaccgatctgacccaatcctagcttggatccccctaccaatctgagaatgaagaaagcagatgatgatgagctctgattgatacctgtccgaaatccgcaagctttagaaccccatcggccgagatcaacaagttcgacggcttgaggtcgcgatgcaccaccgagctccggtggcaggcctcgaccccccgcagaatctggagcatccactgcttcacctcgccgatggcgatccccgcgccacccctcttcgcctccaggatgacggcgcctaggtcggcgggcaggaattccagcacgagcacggcgtcctcttcgtcctcgttccagaagtactcgatgaggtcgaccacgttgggggcgccgcggagggcctggagggcctcgatctcgcggaaggagctctggtaatcatgtatctcctttaggggcgacgaccaggccgtcggatcggcggcgtccgcggtatacgtcggcgtangcgccggagccgatccgggccgangatctcgtaaccgctctatgatct

SEQ ID NO: 844 - DNA, 688 bp, Musa acuminata
  misc_feature (14)..(14): n = any nucleotide
  misc_feature (655)..(655): n = any nucleotide
tagaacttgaatantatggtaaacacaccaaaagaaggaagaacatgaataatagaaccttcatgaataatagaaccttgaataagaacatggtaaacacaccacaagcctgaagaggtcatattacaagaagtaggagaaaaaacccacaaggaaaccaaagagataaacatccaatgcagcttcttctcatgaggtacctcagatcgtttgttcgatatcagggaagccatttgaggtactttttgagttttatttaggaggcagacttagataaatctttggtggatctgttgtatttcatgtgactcttcacgagctgtccagctgcaagagccgagaggagggagagctccccggctagaacagcgcctgccacgacggacgccaggcgtctcgcgtttgccccaggagtgtccaagcttgcacccttcacaccaagtaggtccaagcaggcagactgggaggccagctgagtcccaccaccaactgtgccaacctcaatggatggcatggtcacagagacgtgaagatcctttccatcattgacagcttccatcatggtgatacaatgagaactctccacattctgagctggatcttggccggtggctatgtagatggcagacactatgttgctggcatgagcattgancctccaagagatccagcaaccgcagagccagca

SEQ ID NO: 845 - DNA, 627 bp, Musa acuminata
  misc_feature (4)..(4): n = any nucleotide
  misc_feature (6)..(6): n = any nucleotide
  misc_feature (20)..(20): n = any nucleotide
  misc_feature (538)..(538): n = any nucleotide
  misc_feature (584)..(584): n = any nucleotide
  misc_feature (597)..(597): n = any nucleotide
  misc_feature (599)..(599): n = any nucleotide
cagncntcgaggaccatagncttgggtttttttctgaacaccgacttacagattgacgactgcgtgtcctgagaacaagcagccattattcagatgcagatcatgtttgcaattatgtaatccatgcatgagacaccaaactagtacaatgaattatatcctcctataatccaacaatagattcgcagcttctccatcctcaaatagctctgactgcctcaaatctcggttccttgggctcgtacttctgcttcgcgtacacgtccatgtagtccccgaacagaaactttgggtacagagcaggaggggcagcttcctcggtggcggcgccggcggctggagcgatggtcgccttcagggaggggttgtagaaggaagcgatggagcgggcggttgccgtggctggtggcgagcacccggtgccacgcgctcttgtagcgaccgttgctgaggacctcgatctggtctccggtgtttatgacgatggcgtcggccaaaggtgaacgtcgatccaccggccgtccttgagcatctggangccgccgactttggtcgtcctggaagaggaggatgacgccgcccgngtcggtgtgggcncnaagccctttcaccaggtccaggcgcggg

SEQ ID NO: 846 - DNA, 579 bp, Musa acuminata
  misc_feature (11)..(11): n = any nucleotide
  misc_feature (18)..(18): n = any nucleotide
  misc_feature (143)..(143): n = any nucleotide
cattacttacnaaccatnaagtaatggtatttatcacctatgtccctatcgcgattgttataatgtctataaatattagcgcaacattagaatgtaattgcattaacactctaccaagttctctcaattatcagataataganacaaaaacttacgtgggcgcacaaaaacatggtcatagtttgcttatctttcacgagaagcactactcatccgttgattccaaaaatccggaccttgtgcatgtttgggaatttggcaacctccaaaatggccactgcaatcgtgttcaagaacagcatcggatgttggtaatcggttgtgtgcgaggctatcaagtacaggacgacaggtacaacggtcaaaaatttcctgttacgtgtaagttgctttccattttccatctgctcccaccaggtcaagttattgtagataccctgatcttcagcaaagggagtgccctttttccaatggaagaagtaatatgtaactttgaggcgaggcgaccgaccgcgaagtggaagagattgacgagggtcaggccatcccgggggtgcagcgaagacggagaacacgagt

SEQ ID NO: 847 - DNA, 548 bp, Musa acuminata
  misc_feature (6)..(6): n = any nucleotide
  misc_feature (8)..(8): n = any nucleotide
  misc_feature (454)..(454): n = any nucleotide
  misc_feature (526)..(526): n = any nucleotide
ctttcncngatgaagaatggaagacgcctccagtcacaaaagtacacaaggaaggggcactcggagaaacatggaacgtctagccactctttccttcccctgttacagagagatcagcaacgatggtgttcagtgtgagttatcccatgaagtccagtcggcggcactcccgactctgggcatggagttgatcttggcgaacgtgtccaccttgaagctggcgccgcacatcaccccctcgctgtctaccctcggcatcgccttcagcctgttcaacgggtgctcgaagctcctcaaccctccgtcgctgtgaaacatgcatccagtagggaacggagcgtaggatttgccgcagctctcctttgtgatttccctgtcatcgcaaattacgatcgagctatccgctgcaacgccccagtacagaggtattcctccatcggagctcagcgcacanagaacggtgctggttttgttgtcgtagacgacgaaggcgaaggagccgctgaagtccttcacgactggtcgncgggtacggccgcggtcgggag

SEQ ID NO: 848 - DNA, 748 bp, Musa acuminata
  misc_feature (61)..(61): n = any nucleotide
  misc_feature (525)..(525): n = any nucleotide
  misc_feature (527)..(527): n = any nucleotide
  misc_feature (529)..(529): n = any nucleotide
  misc_feature (562)..(562): n = any nucleotide
  misc_feature (573)..(573): n = any nucleotide
  misc_feature (583)..(583): n = any nucleotide
  misc_feature (668)..(668): n = any nucleotide
  misc_feature (673)..(673): n = any nucleotide
  misc_feature (695)..(695): n = any nucleotide
  misc_feature (699)..(699): n = any nucleotide
taaatcttcttatgtggttgggttgacatttcattcaccaagaatggagtgcttgaaaganactctaaaagcgttaatctcatcgtatcatcgagattcccagattgagttctagtggacgcaagctaaagaggcagacggtgaaagttcgcatctaccaaatccttactctgagatttctgtttcccagaacaatacgaattctgaatcaccacagaagaatcgatcaacatgcgacgtaaatgagtatcaaccataataacagatgacttttcctccatggagatcgatgcagcctcagtggccatgttcaagaagccagggttgttcttgagcaactgtcaacggcacaaccgagaacatcacggtaatcccgggagatgatgaagtgatcgtagacccttccatcgctgctccttttgtactcgagtagcagcatcgaatggttgaaggctgtgagctttacgaacccgtagtcatggtcttgatagtaactccatctcgctcggaccgtggtgaagtcancnangctggcacctccacctccgacaactacatgtgnggttgcttcgnaggggccacngtaatagttcgatcccgttccgtatgcaggtgttctgatagacccgggcatgttctttcatagttgtgtacatgtcccaaaaagngcatntcaccttgtacttctggcaganttcntgaaggctttctcttcccataggctcctcagatgttccttcatcaccat

SEQ ID NO: 849 - DNA, 537 bp, Musa acuminata
attctcgaatgtgatttgatattataattatcgttgtgaaaggcttggatcttatgccacttgttttagatgatgttgtcgtcttttctagaagatggatgatgaacgacttagatctttgtcagaaacgagagagagcggcaggaacttgcttctcccacgtacgtgtcgaccgtggcatcaccatgatatctcactcgcaggcggtggcggatctccggtgcactcgaaccgacaaccccccggtgatggtggcggtgaggccgggagtgaaatgcggggaacggcctccattaatcacctcgatgtcgaaccttggaaccaccgagacgatgacagccttcatctccatcagagccatctccttgccaaggcaaaccctgaggccggcctggaacacggggtacttgaataggccctccggggtgaagagaccatcccaaagccaccgctccggcttgaagtcgaagcagtcggacccccagatgcgctccatcctccccatggcgtagggatggtacgtcactcttgcgttct

SEQ ID NO: 850 - DNA, 558 bp, Musa acuminata
tctcgtaatgttttgaaactttaaatgttattattatacagttgccaatgctgacagtaagagatctgagaactacaggattaagataagaaaagcttctaggctgattgatataactatattaatctcgttagccagttttgtatcgagaattcaggagctctttatcgatacccaatgagtgatgggtgtccggcacggccaaaaatttctttagctctttcaaagaaagtgatcgatcatatgttgtataacatctgcaccttctgaatgcatgaagggatccttaacctgaatcacactgtgtgcagcaaacctctggatgctgatgttgtggaaactaacatccaccctctcccaagacaaacgagtgaggcctgtcaccagcttctcttaacacatcacagtcatcattcataagtgagtcactagcgcacttatcatttctgcttcctgctgagtattcttcatatacaatatgtgggtatctctcactcaaagaatcctcccacttagggcagctcagaagtgcgtcttatgcatgatgtcctccacccc

SEQ ID NO: 851 - DNA, 519 bp, Musa acuminata
  misc_feature (14)..(14): n = any nucleotide
  misc_feature (498)..(498): n = any nucleotide
ctccacaaacaaantggcagcaacacaggcaggtttcagtggacacgagcacaacagtatccattttgaccaacgtgggtcgaccgcctctgaccaaacgcacacacgaaggttcccggatcctacttgtggtccctgggcccaccgaaaaacgcagacccttcgctatatatagaactcactccacgaccaagaaatcttcacaaccactagagatcttcttgtataaacatacataaagcaacgagggagagtgagatcaggaggaagatagagagcttacttttggcttccagttgagcgaagacacacttaccattagttagtccagcggagaagacgaccatggggaggacaagagacgccgaagcggagtcaatttgccgccggggttccggttccaccccacagacgaggagctcgttgtgcactatctctgccgcaagaccgcctgccagtgcctgcctgtgcccatcatcgccgagatcgatctctacnagtacgagccttgggaacttc

SEQ ID NO: 852 - DNA, 561 bp, Musa acuminata
ggctttatgggatttcaccaaaacattctcaactactgagaacaaaattaatgatgcctatgaaatgggccagtctgatttgttcaaaatcaaaactcaatccaagacaatgaaacagctacaccaatcaaaaattactaagttcttcaaccgaccaaatcatgaattctaattctgatttgctaccttggcaaaaaccccataatctagtagaagaatccgagtacttttccaccaacgttcttcctcctagcttcttcatgatccatgattccagcagatgttgtcagcacaatgtaaccaaactgacgtgatggaagtagtctggcagtccatggctcaatctctttgacaccaacatcaaatcgtgggctgatgacaccacatttgttcaatctcccattcaactcaacaactatcttgccagctcggtggtcatctacgatttcaaactcaccaatatatccatgcttctgcatgacaaggaggaacttgattatcactttagaggtggtcaatcatgactgccgctttccacgttctcggcattgtacatgctct

SEQ ID NO: 853 - DNA, 589 bp, Musa acuminata
  misc_feature (368)..(368): n = any nucleotide
tttcatagttttttccaacaaaatgtcacagaccgatctccgttacaacgtcgatgagatgggtggattctcttgtccttctacgttcctcctgttactccgaccaatacagaggccgaaggaagacggcacgcctgcttcgacttcagatccttcagctcttccacccacaagctgtaactcgatagcggagccaccacatccaccgacacctcctttttccgtatcagtccgttggcgtactctcgaaaccgtgcaggttctcccaaagcttcaccagcttcgtggggttcttctcggcccaagcattcttcacgctgtccctcgcctcctccaccttgggcccagaagcacgagtcctgcgtcancccagcaaacttactccgcttccgatgagccgccgccttctcggggacatccttgttgcgatcgttccaccatctgtcgaacacttcgtacctcctctccctggccatgagtcaggtaatggcgctggtcctgggcactggcatctgtagtactccgcgatgtcgagcggcttcaccaggagttgtagactgagtggattcacccattgttcgttgtggaa

SEQ ID NO: 854 - DNA, 716 bp, Musa acuminata
  misc_feature (42)..(42): n = any nucleotide
  misc_feature (572)..(572): n = any nucleotide
  misc_feature (578)..(580): n = any nucleotide
  misc_feature (582)..(582): n = any nucleotide
  misc_feature (701)..(701): n = any nucleotide
  misc_feature (707)..(707): n = any nucleotide
cctaacaagaagaagccaagtgatgatatcatttatttcgcnaaacaatttcttgacgcatggcgtgtgctacattattactggaggaaaacaagtcatacattcatctcctattccttcgcttttgttgccaccaattcaatcaatcgtgtcacgttctcatacgaagaacctccctccatcatcgctttccgtgccttctctccaaattcttcagctctccttctcctctcttctccctcctgccctccgtccatcaacctctccacggccttagcgacttcctccctcgagatccgcgctccctcttccggcgattgcctcatctgctgcatggaggtcttgacgcccaccgcgactccgatcccgagcacatccaggatcaacttctcgttgaggaattgctccgagaagagcggccatgtcgccatcggtacgcccgcactcgcgctctccagcgtcgagttccacccgcagtgcgtcaagaaaccacccaccgccgggtgcgacaggatcatcacctgcggcgcccaccccctggatcaagagccctgtggagacaccgcctttcncgagcnnntntgcagccatcagatctggaatatctgagttgtagaataatgttagggggactactgctccatcagtaggagcattgcagtaatgtcatttgattcagatgctttgtggattgtttactnttcaanattgtcctc

SEQ ID NO: 855 - DNA, 802 bp, Musa acuminata
  misc_feature (12)..(12): n = any nucleotide
  misc_feature (14)..(14): n = any nucleotide
  misc_feature (32)..(33): n = any nucleotide
  misc_feature (35)..(35): n = any nucleotide
  misc_feature (37)..(37): n = any nucleotide
tcgcgcacggcncnccagttttttttaacganngngngattccatttaacttaaatctccaaaagtcaacagcttcaaaattaggcatgacagcataacaataaattgtctatcaaagaaaacagtccaagctcactgctgaaaacacagaaaagtttgatgctgactcaaaaagaaaacagacctacaaagccataaatataaagcatcacataacacgctttagatgagatcagcaacattggaaggcagctcctctatcacgacattgtagaacttctggatgtcaaaaagcatcctctcgtcatcacgtgtgacaaagttgattgcaacaccctttcttccaaaccgtccacttcgtccaatacggtggaggtagttctccggctgagttggtagatcataatttatgaccagcgagacctgctggacatcaataccacgagcaagaaggtcggtggtgatgagaacacgggaggagcctgagcggaattcacgcattataatgtccctggtgttctggtcaatgtcaccatgagtggctgagactgtgtgatccctgctcctcatcttgtcggtgagccagtccaccttgcgtcgggtattgacaaagatgacactttgagtgatggccaaagtctcatagagatcacagagggtatcaagtttccactcttccttctcaacattcacatagaattgcttgataccttccagagtgagttcatctcgcttcacaaggatcctaacaggcctattcatgaacttccttgtgatctcaagggcctcaggaggcatcgtg

SEQ ID NO: 856 - DNA, 769 bp, Musa acuminata
  misc_feature (7)..(7): n = any nucleotide
  misc_feature (15)..(15): n = any nucleotide
  misc_feature (20)..(21): n = any nucleotide
  misc_feature (51)..(51): n = any nucleotide
  misc_feature (683)..(683): n = any nucleotide
gatgganatagattnctaannaaaaagataaaaacattccaagaagaaganttagttgctttccttttgtactttatgtacaaaacaaagcgtgtaagagattgaatatcctcgaacttggcgctcgtcttagccatcaaacacaatggaagacttatgtgtttgtggtttaacattaatacagtaaaggcaagcaattacacgcattaaacaatacatgtatatatcatgtcatcacgatttggaatctgatggaattttcttgtgttgggtgggtggcttagattggatcgttggtggctctgaacatgtcgaggcagctctcgcgttggaggcctcggttccagaacgcgtcatagtactccccatatgtgaagcttcggtagactgcaggatgctgctcgtcaaccagtgcttgagctggtccaattactgcatcgggagatgggcaatagaaggtgggaatagaaatcctctcgctggagtcgttgacgactgcgcgatggagcacgcttttgtatcgatcattgctgagcacctgaatctgatcgccgatgttgatgaccaaggcgttggggatggggtcgacggccacccacttgccgttcctgaagacttgcaagccggagacgccgtcctggaggagtagggtgatggcattggggtctttgtggctcggcagncccgtaacgtgactccggtgtgggcatggtggatagtagtttatggccatgtgttgtcctgcttcgcagtgccttctcatgtagtc

SEQ ID NO: 857 - DNA, 660 bp, Musa acuminata
  misc_feature (5)..(7): n = any nucleotide
  misc_feature (27)..(27): n = any nucleotide
tattnnnacccctgacgatcacaacanttcatttgcaattaacaaagtacgttacacatggatgaacaagggagtagcattggtctatatgcatttaggcaaatcaccacactgacatagctgatttcagactggaactagttgtcagaataacaagcaaaagtctatcgcctacgatacatggcacgagttggtgagactagacaagagcaggatactgcttggcttgctgtcgaacacgtcttctgtactcttcaagatcctggatgaaaagatgatagccatcggtctgagcaggatcagcaggatttggctgatctagtaagtcttgtatccccacaagtatttgtttcactgttatggctggcctccatccactgtcctcgttgagaattgaaaggcacactgttcctgaaggatagacatttgggtggaagaagccctgcggaaacctacacttgggaggtttgctagggtaatcctcactaaaatagagtgttaggggaaagtagccgccttcccagtcagtccccggcttaccagggatcgtgcaatgccatatcatcagattcacagtaccatctgccatgttctggcttagcacaaaaccatgggggtgattcttacgcacgctttggttcttctgcgagacgaccgcgt

SEQ ID NO: 858 - DNA, 562 bp, Musa acuminata
  misc_feature (289)..(289): n = any nucleotide
acattatattttattcagtcaagttaaaaagtagctacacggagcgcactacacggtggtcgtgtggaaaccgtcatcacacacacagctcgcaatacgtttagagtagaagggccggttgctgcttgtgggaggagggaggggggtggaggagcgcgagggccctctcgaactggctccacctctgctccagcgtgccgctgtagcccacggacaaacggacgaggccgggggagatgccggcccgggtcttctcctcggggctcatctcgctgctggtgctgctgcncggagcaggacatgagggtctcgtagtatcccaagctgacggccatgaggccgaactgggtggtgttctggaggtggtgcatcagcttgttggcccgctcctcggtgcccatgtccacgcagagcatgccgccgaagccgtatccggggttggagatcgaggcgagcaggtcgtggtgggggtggtcgtccagccccgggtagataaccttgagcccccgccttcctcatccgggtggcgtactccagcgcgcggtgacagtgctccttcatc

SEQ ID NO: 859 - DNA, 1199 bp, Musa acuminata
ggccgtcgtcgacgagatcggactgagcgagtggggttacgcctgtcgccctttgcagactaccacggttgctgggactccgaccctgaggtttcggggctctacctcgtccaccagatcaacaagcatggccttctctacttgcatatggtggagccgaggatgtccattgtggaaggcaggcgccaaatcccccaccggcttctgccgatgaggagagctttcaagggaaccttcatcgctgtcggcggatacgaccgtgaggaaggcaacaaagtggtggcggagggctacacggatctggtggcttatggtcgcctcttcatctccaaccccgacttgccgaggaggttcgagctcgacgcgcctctgaacgggtataacaggctcaccttctatacttctgatccagtggaggggtacacagattacccatttctttgaccttcggccctgagactatctcaactgagttgactttgaatcttgagccaataattctttgtgatggcattgtcatgatgcattatcgacactaaaaacaagcttgaacattctgtaatgaattagaggcttcggaaaagaagtgaggtcttatgtgtagacaagctacaattcatttagaatctccaaacatttaatgtgctgattaagtatactgaattaattgtccatatcaaatgaaaaatgccacgaaaactggattttaactgcaacagctgctcttctgctcgatgggttgacccttcatctgaacagtggtaggtttggtatctgcagtgtgttggtttcccattcttttcttaatttcagcacacatggttaagaaagctttctccacattgattgaatcctttgcactcgtctcaatgaaaggaataccaagtgaatcagcaaatgcctttgccttttcagtttccacaactctgtcctcaaccaaatcacatttgtttccaacaagaagcttgcacacactgtcactagcatatctgtcaatctcacttagccactgcttgatattgttgaaactttccatctctgtaatgtcataaacaataatgatcccatgtgctccacggtaataactgctggttatggtcctgaaccgttcctgtctgctgtatcccacttcaagcaaacaagatcattgcctcaaaatgattgcactagactataacaaaaaatagcatactagttct

SEQ ID NO: 860 - DNA, 657 bp, Musa acuminata
  misc_feature (21)..(21): n = any nucleotide
ccggctcaaagtgcaatttgntgcaaggtggaagagccttgtaatagttactgatcaatagaagtcactcggtgaggatcagaaccaatccataatatcaaaataaagatcactggaacattttttccctgagcaacagcaagttcaattgcccaaaaaaatgactggtggccaaaaactaaatcaaagttcatcatagtgtcctaaatcaatcatcgataagagaaaataaagcactcgaccttagttcatcgatctgacattaccacttcaatctccacaaagttcacggttctgcaattgtgacttcaacttccacacccggttcaatggtgatcgaagtaatctgcttgacgacctcagaggagctgacaagatcaattacccgtttgtggacacggagctcaaaccgatcccaggtgttggttccttcaccacagggcgacttcctggtggtgatatggagcaccttggtgggcatcctcaccggacccttaaccgtgagcttcttgtccttggcacccctcaccagatccgcgcacaccttctcgaggttcttgacgttcttggacgagagggtgatccggatgcggtgcagtgtcctgaggctcttccagccccggttcgtgggttataccgtacgcatctcgaaggtga

SEQ ID NO: 861 - DNA, 691 bp, Musa acuminata
gtcaccaacaacgagctagccaactctgaacatgatccatgagaacatatcttgctccccaaacttgtccggactatcaaaagcactattttaagacacacacaaatcaatatcttcagtaccgtatactacaaaggtttaggtttaggtttatgttgaggttttccatgacaggggtgcacaagaacgtaagccctggaacttacccacaaggagtgagtttcttattgcctgcaccacgaggatggtcatctttccaatcgtcccatgctcttgctttttccacctctgcgtcttcatcctcggtcgaagtagtgccctccttgtgccacgaagagttggcttcttccatgagcttgacattccactcttgccatttcttcatcatctccatttcccgtaagccagcttcttctatactcatggttggtagcctataacctggttggaagacttgtgctgccattctctctctctcactagttaaccttccaccgacaaggctagctggtccaaatatcatgggttggtgcttgtgttcatgtgcttgtgaaagctgtgctctaccttcgataacatcttgggcaaaggttgcacatgtgatgggttctgctggttttgaaactgctgctttacttgcagattcctatgccatgtttagctcgtttagtacgctatcaagatctcatga

SEQ ID NO: 862 - DNA, 534 bp, Musa acuminata
cagtaatattctaacggctagcgaaagcgtgtgattccaaattaactacaaaatatttgatttaaaaagagaaaaaaaaaatctgctggactcaacagcccccgtcagtcaaccctcttcaagaaacgagaggagttctgatctcagatccccccccctccacgtcccaatggacgagtagaatatgcccacctactactgcttgcttaaagctcgtcatgtgaatcatcttcgtcaccgccatcggaaccaccgggtgcgccgccggacctctgatacactgcagaaatgatggggttgcaaacagcttccacctccttgagcttctcctcgtagtcctccttctcggcgctctggttgtcgtcgagccactcgagtgcgtccttcagggccgcttctatcttctccttctcctcgttctcgatcttgtcagccagcttgtccttctcgttgacggtgtttttcatattgtacacgtaggtctccagttggttgcgcgcgtcgatcttctccttcactttcctgtcctcctcg

SEQ ID NO: 863 - DNA, 580 bp, Musa acuminata
atcgccgtcatgtgcccttccataataattaattttactgaaatcatgctgatgtttccaatcatcaatacaagtacacacacccgtctgctaatgacaagtaacgaagcgcccatccgtggcttcatgcctcgcctcctgcaccagctgctgctttcctctctgcttccgctaaatctggtctttggtactgcccgtgcgccatgtcgtaagtagcatggagtccaaagagcagatagtagatcagcatgatcccagagcagatcccaaaccttaggaacgccttggattccaaagagcccatgagaaacaagttggtggcgatcgacaaggacggcaaccatggcaccagcggaaccccccacaccttcggcgtcctgcactgtggcacaaacagctggagtcccagagtgccggccacccacataggaaccaggatcacgtacccaatccacccatggggcctcagtccccagtaagctgaaatgcctgtggaagaggcaatgatgaccagaaggcagatgaccagcttgtggaggtccctcggagttgagaagtctcgccggtagtaccgccttca

SEQ ID NO: 864 - DNA, 625 bp, Musa acuminata
aagcaagaatcacactgacatctcatttgtatttcttttggttctcaagagcaaggaagtctacacgatacccacctcaaaaaaccagagatagaaacagaggtaaagattccaataacacagacctaatttgccaactattggcatagcaatgacagacagactgacattattgataacattcagagaatttttatctttgactaagaatcactagagatgcgacggtagggtggtagtcgagcctcacttggtgctggccaattgggtgcggaggagcttcgctgcggaaaccatgttggtcagagcaggcttaacttcaccatacttgcgagtcttgagcccacagtctgggttaacccagagaatgttagtctcaagaacggcaagcattttgttgatgcggtcggcaatctcctctgtggatggtatcctcggagagtggatgtcgtacacgcctgggccaataccagcaccatacttcactccctcacggaacacagagaggagcttctcgtcagaacgggagttctcaattgtgatcacgtcggcatccatgtcgatgatggaatggatgatatcattgaagttagagtagcacatgtgggtgtgaatctgagtagtg

SEQ ID NO: 865 - DNA, 725 bp, Musa acuminata
  misc_feature (27)..(27): n = any nucleotide
  misc_feature (30)..(30): n = any nucleotide
  misc_feature (37)..(37): n = any nucleotide
tcagtctgccattggattatagttttnganttcagtnacaaataccatgataacaaaacatcagacagtccaaattcagatccagaattgttaatttcaaaagaagataaaggaactcaaatattacacaaaaaggagaaaccattaagcaaacatcaacattacctaagttgaacagcaaccaagtttcttctgtgtagaagcatcatctttcacatttattctctcacctttactaggaacagaagaagatgctgcatcatcacctgcctcgactgctctcttgctgacaattcggtaaatctgagtcaggacttctgcaaatgcattgtctacatttgttgcttccagtgcagatgtttccataaaatataaggattctctctccggcataacccttgccatcttcagttggaacagcaacaaggtgacggagatctgacttgttcccgatcagcatgacaactatgttaggatccgtgtggtccttcaactccctcagccaacgcgaaacattctcaaatgtggcgcgcctagtgacatcataaacaagcaatgcacccacggctccacagtagtaagcacttgttatggcacggtacctctcttggccggcggtgtcccaaatctggggccttgaggaccttgccgtcgacggagatgctgcgggttgcgaactcgacgccgatggtggacttggactcgaggttgaactcgttctttgt

SEQ ID NO: 866 - DNA, 642 bp, Musa acuminata
  misc_feature (611)..(611): n = any nucleotide
taagttactcaagagatgaacttgaacatcacccttcacagtagaagcagttttcggacgagtcaatttaagttcaaagagcaaattaacccccaaaactaacacgagtagtaagtagtccaaataaagtatcataactagtcaagctacttttagtatcaaggaacacaatttagcttcaatcccccttaaaatctcagctacaaattccgaaaagcatctgcactgcagcattgactcacctcctcaaatgttgctggggtacatgaaaaccctgaccgttccacccatggatttaggcggcagattggatttaaacttggcgcggatgacgccactgttgccgtgggggcgtgcgaccttaccccagatgcaccggtaccgcgtccccttggtcttcgtcttcgccttgtagatgtacgccatcctcttgccgcagtaccaagcgacttcctccttggtgttcaccccctcgatctggaccagcgatgtgttctcgtactggttcgacttcgacctcttgtatccgaggatcgtcccgcggacgtacagcctgacgcgctcgccttgccgccccttcaacatctccgccgatgagggtgccgcgacanatgcgccgactaagagcagccaaccccaagt

SEQ ID NO: 867 - DNA, 586 bp, Musa acuminata
  misc_feature (7)..(7): n = any nucleotide
gtcacantcttatattccatcttattatttggagaaagtaacatcatgatagatagaagagaaatcataggccaatgttctctttaaggataataaataacatatccccactctattttgtgatctcaatgatccatgtattagcgaagatgtaagtggttttgaatcctgagaagcctgcttctcttgccaagccctcgtactctgtctctgtcctctccttccctcccgggttgtgaaccatcatcacgacgtccaaatagaagacttcccggcctcgccccatcggctccggaaccaccgggaggacgcactccaccagtataacccttcctttctccggcaatgccttccaacagttcctcagtatcttcacgcacagctcgtcgctccagtcgtggaggatccacttcatcaggatggcgtctccgctcgggacgctatcgaacatgtcgccgcctctatgctcgactcctgcgatgggtggcgcctcggagatgacatgggggaggtcgaagttgatggcttgatgtgagggtgcttggcggcgatgatggagatggtgccgccgacgcgccgccgacgt

SEQ ID NO: 868 - DNA, 361 bp, Musa acuminata
  misc_feature (14)..(14): n = any nucleotide
  misc_feature (338)..(338): n = any nucleotide
tttcactgattagnttctcgtaattgaatgatctggtgacagacaaattggcggagaccaaagggtatcgactcccgtgtgcgcagaaagttcaaaggatgtaccttgatgccaaatatagggtatggttcagacaagaagacacgccactacctgccaaatgggttcaagaaatttgtggtccataatgttgccgatttggagttgcttatgatgcacaacaggacctactgtgccgaaattgcacacaacatttccacaaagaagcgcaagttgatcgtcgagcgggctgcacagcttgacattgttgttaccaacaagttagcaagattgcgcancagaacaacatttaaccactggc

SEQ ID NO: 869 - DNA, 584 bp, Musa acuminata
agagtttgatgaacacaaaaaggagaagagcatttaaaactaacaccacatcaaatcatgtccggaccacaaattggcgtacacgagctcatcagccatatagtccaggagggttaacctagtaaccatctcaggctgcagaaacacctgcatctttgattgattcacgccaagcatattctctagctccatccttgtcgacaatcttgatcacaaagtttggaggagcaacaaccagtctggatcggatttcaatgatacaccttgtcaactaagtcaatagcttcctctaatgacatcccgctcttgtaatgtcggtccatcatcgataacgtaaaataggatccataaccaaatgcgcccttgtcaactttgtggagagtagcaatgtaatcgatatagtagagagatgggccaatattcttgtcatatccagccagcaaaatgttaacaaaatatggattcttgcggaggggcgatggcaagctcgccgcgggtgaagtttgcagtggcggcgtggtaagcgggatgccattccggactcatagaggtggacgttcttctgggatgtactcggtgaactg

SEQ ID NO: 870 - DNA, 682 bp, Musa acuminata
tatgtaccataaaggtttgtttggaaaagttctaacatgcggaggtcacaaacccattctgatataacatgaacaatcgtcagatattcgattataacctactgagaacaattcacccaataatccatcagcacaaagaagattgaaaaagtgcagatgccttatgagatacatccaacttgcgttttgtcaaaatatcataattgtttcagcagttgtggtttgatcccccagttgtcacagcaaaatgatagcaaataggagagcaacttgcaactctactacatccacctcgatgataacagaaagcaaccgcaataaaattaatcttacgtgaacatcagtcgcaaaaggtcccaagtatgtcatcatctctgtagaggtggtactctttctctccaagcttcacctctgtcccgccatattcaggtagcagaacagtgtctccttccttcacagagacagggataagtttcccatccctatcacgtgccccaggacctactgctacaacttttccagagttcaacttggtggtcttctccgggagaaggattccagcactggtcttggagggagggacgatcttctccacgagaacgcggttaaagagaggaatcaggcgctttcgccatcgacggccggaagaagaaagcgaaacaacctctagtgagcttctttc

SEQ ID NO: 871 - DNA, 578 bp, Musa acuminata
  misc_feature (11)..(11): n = any nucleotide
aatgataattntttcttgatgcccacattacaacattggaccaatcgtgggaacaattacaagaaccagacaaaagacagacccacagctacgaacgaatcccttaccatgtcattttgtgtgctgatctagcggcgcccccacaagtcgagtacactccctccggtccaccgatcccgacgattaggcagtcacagatgtctccatcgcaaccttccccgagtgccggatgctgcctgatttctctgccttctcccacagctccggcagcgcctccctgatgttgtggatgctctccaaagcatggtccgcgcctttcactctgtgtgaagtccccaccagtacggtctgcagaccgatgcgttttcctgatcgaatgttccgtgcactgtcatcgaagaaaacacttctttgggggtcgatgtttgcgagcctcagcggcgtgctccatggcttccacggacggcttgcacaccaccggcgtcttgggtagttcgattccgctagtgtcaggcttcgagaagtggtcgacgatgtcgaagatttcgctcggggtttgtgtgccgcagaagaggacg

SEQ ID NO: 872 - DNA, 648 bp, Musa acuminata
  misc_feature (9)..(9): n = any nucleotide
  misc_feature (47)..(47): n = any nucleotide
taggttctngatttgatgatggttcaaacaatgctattctctcgganactcttccgaaaagattccatgttactacaggagaaagaaacgtgttacatatttacatgcgtgaatactttgctctctctcgctcctccatccctatccgatctctttattccaaattcttctcgtggaggtatccatcaatcctgctgtcagtggaggccggcctgaccgtcatttggcttggcatgccgccgagcaagaagacgtcatccatctccaaaccagtggcatagttgtggaggctctgacgaagaaacgcgtcatgctgcaggctgctgccgttgctcctgtcgagcctaaacggcgtctgggtgtactgatactgctgaggatgacgacgatgatggtgatgttgatgaggttcgtactggtgctcgaggtatgtaggctgcagtaggtgccccggcggcgccacggtcgtctgcgggtcactgaagtcgaggccgaaaccgggacggtagctggaagagtacggcccagacgggaacccggtgaactgctgcaccatggctcggaaattggaggtgtcggtataagcaggtgaccggggctctccgggaggtctcgtccgccgccgggccggctcacactcggctctcg

SEQ ID NO: 873 - DNA, 660 bp, Musa acuminata
  misc_feature (613)..(614): n = any nucleotide
  misc_feature (657)..(657): n = any nucleotide
actttcttcttccactatttgaaggtaaaaatgagttaaatattttgaccatcacaagaaaacacaattggaaagtctttctaccaccatagttgctacacttgacatcttagcccctatgataaatactacaagaccaagcaagagccgatgacaacaggcttcattgttgagatcaagcagcctgggatagcagctcatgcaagggcaactcctaaaggcttttattctggtgcagttacttcagtgtggcacgcgatcaatctttacaacctggacatggtgcgactcactgttgcttctatagttccatgtggctcgtcggttggcatgtagacatcatcagcaaactttaccatgtttgggttatctttgcttgataagttgactggtaagaaatggaggtttggcattctaagcttaaccgatgctatatcagggaacctgttaagaacagcttttgccatgaggtacagtgtgttctgaaccgatggactgtaaacaccctcgagtggtgaaccaaagaaggtgtctgctagaactttcttgacatccagatacctttgtgtgaaacaaaatggcttggcaggatatcagtacgtcagcaatgggnnctccaagcagcagtgacttcagttgcaccatctctccttgtcntgg

SEQ ID NO: 874 - DNA, 621 bp, Musa acuminata
tgtatccaagatatattacatgtggtggaatgatttattccagatgttcagcttgcttgtctgctatttagtacagaaaaaatatatctgatgccatacatactgttaagtatatctagaaataaacagtagaatgcctcaaaacagctatttgtagacatgcttagacttcaacaatgcatctcgctttccaaagtggatttcatgtttcaacctagtcttggggcttttccagctcctccatgaattctgttgtcatgacaagataatcctccaagtgcagtcgcttccattcctcaaaatcccactccccatacaagtttggatcatccttgttaccccagatatatgcatcaactattagtttctcagaattatcaaccaaagaaacctcaacagcccttctctcatattcgaggtcttcaaaggaatctaggacatctaactcttgatctgtgatgccccgtaaaacctctcctgcaacattcttacaatctatgggcaggattgctggataaacacgggccctttatactaaatctgtggtaattatggaggatggcaggggaggaggggggaactcgcttgagaagcacgcgcaccaacctcatctgccaatag

SEQ ID NO: 875 - DNA, 774 bp, Musa acuminata
  misc_feature (12)..(12): n = any nucleotide
  misc_feature (132)..(132): n = any nucleotide
tatcggatgtantaagactatccccaacgagggggagagtgtaatgtctgatgacggaactaaatccatacacatgagagaattactcggatccaatgacaagtgcattatatgtataatacatattgctgntttctcctgaaatatgtagaaaggtctttgcaacaaaacattaatttttgcctcagaaaatgttcagcaccacaaacttcctgccagagtgaatctgcaggcactaccgtggatcgatcaccgtgatagtaacctcgttcacagaatgcgttcgcgttgaatcagacttggtagccgatgacttgagtccgtccgtcctcaaccttgcgaacgacgggggttcatttggcagcgggagaggcatctgctcactcttcaacatcagcagcaccgacgacatggtgggtctgtcgtctgggctctcctgcacgcacagcaacccaacctggaaacaccggcgtgcttcgttcgtagggtaacagtctccgagcgacggatccacgaactcggaggctctgtccttctcccacagctcccatgcatgtctgagaagggtttggccgcgttgcagaacgtgcgatgccccgtttctttgcccattcaggatctccagcaggagaacaccatagctgaagacgtcagacttgaaacgagaaggtgccttccattgcgtactccggagccatgtaaccataggttcccacgactctgccagtgttgacttcgtagtcttctcctcgaagatcttcgccatgccgaagt

SEQ ID NO: 876 - DNA, 596 bp, Musa acuminata
cactcaaaagttaacataagtcgaaacaagtgccaaaccatcaacaagcaaactagtaagcaaaagccgattaagttaagagtactcgaacaaaagcttgccatcaacaaaatgttcaattatactcttccgcctccagctacagaaatcaagcaacctatttgatgacatttatagcgctaccaatgacgagatgagaagacctaagtcattctctgggcggcttcctttgctagtaccttctccctggccttggattttgccagagatttggaaccccatgattccaccaccccacttcctcctgacctcatcaaacttgtcattgaaattggccttaatcgcttccaggattttgctgaattctagtttgtcctcattcttcacagtggtcagacacaagactgatgctgttttcttatgcacgatcgctcctaaacgggcttttcctttgacaatacagtaagggatctccatcttcctacacaaggcgggtagccacacgacaagctcaattggatccacatcgtgtgcgataaccaccaactgtgccttgttctgttcgataaggtaagtgacatgattgagcccatact

SEQ ID NO: 877 - DNA, 944 bp, Musa acuminata
tgatctttatgagttaaaaagtaagagacttaacaaagtcatgtaaacactcaagtttacctctacatgcatccccttcaacattcaaagcaaagatacaatggattttctattctcattatgtagcagttttcagtcgacttgagaaaacaaagcatggtagtagaagcagacacggcacggcgatagtataggatccttaaaagccaaccgacgatactcacggagatggaggccaatcaaacacagtgactgcatcactaaagccacccccgtagaaccttacttcaaaaccctccaatccttgatcatcctcccatatgctatcatcgtcgcttaacccctcgtagacatcttcaccgtcttccatgaagtcccaagtgtgctcatcacaacaaccaccatgatggatttatgaacttcatgcacagggatgaggaggtgaactacttcccctccaggtatgatcctgttcgacatgcagagaggttcccaatcccatcctctgttgttactggaaggcgtgagaaagctatcatcaacaaggagaacaactttaagcagcctggagagagataccgctcttgggctcctgatcgccaagagcgattcgtccatagatgggttgatgcgttatctgaccctcgagtgacacatgaaataagggacatatggatttcctactggtctcagtgccgacaagtctcttggtcagaagatcgcaacccgtcttaatgtaaaaccaaccatgtgaggtgctgccaattatggtcaagaataagctttgaaactgcactactgagaattggaatggtgtccagatgaaactgatgttaaatgtatttgtactgagtacatccgagtatgatccatttatgactgatcctggtattataatgtactgttgagtcttcctatcctactatctacatatcatgttcttt

SEQ ID NO: 878 - DNA, 605 bp, Musa acuminata
  misc_feature (38)..(38): n = any nucleotide
gtccttcatttatttcaagctaccaccttgacttcctnggttgagggcttgatgctctattcaaaatggcctgctcagcttcatttgctttcttcgatgatcgattcttcaactcttcctccctgcgctgcctatccattctccgctggactagacggatgaaatgttgtgggggaacaaaagcacgctccatgtcaactaatgcaaccaccatctttttggcctcatttctaaaattttctaatgcagtagatgcaattgcaaccacctctctcttaaatggaggatatctgcctagtcctggggtagcattcgctgcaccagaaactatatccactagaacacgatgcacctcatctacgcaaaggcgtgatggttcttttgcaagttctagaactccttttattaaagatctcaaacctttctctggagatatcaaatatggctgataaccatcagcttccaacacaatccttttgacattattgatatcaaaatgtctatccaatggaagctgttttattctgttgggaaaatttccttcaaaagttgcaacaactttccaacctgcacctcaccagtagcaatgtgctgcagaaacttat

SEQ ID NO: 879 - DNA, 616 bp, Musa acuminata
  misc_feature (510)..(510): n = any nucleotide
  misc_feature (521)..(521): n = any nucleotide
  misc_feature (524)..(524): n = any nucleotide
tttttattctcattatattcttatagcatgatctctgcattcttatgcagacattatattcttatagcatgactgacagcatcataatctctgatacttatccgtgtgcattctaaacattcttcaagaatgggcagctcgaagcaggcagtcctgcgtcctccatcttcgcacccttgaggaggccaccgagtagctcaccacgatcgtagaagaactccaccttctcgatcttcatgtcctcatcgacttgaaatattgccatcccatagagctccaccatctcccccgtcggtgcatggccttggaaaggcccctccatgaagccccagtgccggaacttgtacacgatccccggcgggccgctgtagacatggacgacctccaaagcgaacccacgaggaaacgccgtggtgaaggcggcgtgagatgactccatcgtctccctcgacgggtcgtacacgcgcaggccttgcggcagcgacgtctgcagcagcgagttgtagccgnctcccaacttncgnttctgttctagcgttatcggtcttcggcccattgaggctgaaggtgtaagttatccggattcacggttttgtagtcttggaatcgtctcttg

SEQ ID NO: 880 - DNA, 675 bp, Musa acuminata
  misc_feature (35)..(35): n = any nucleotide
  misc_feature (56)..(56): n = any nucleotide
tgaatgaccaaagattttctacgcagaacaacaanatatgacattgtatcttatgnagggtactaatactcatacaggatatgaaccgctaattgttgatttaatagaacccctcctatgcataacacggataaacttgtattgaatgtgaaaatcatggtccccttattgaaacaacactccatgggtcgctcaaacttggctaaaccagtagtatagtaacaaatatttaagttccatagtttgccgcataggtaagttctcagatagctcgatgataaccatcaaagatcatagagagatttaccatttatgaagtcaaccacttcagtaacagcatgatcaagtgcggcagtaactgcaatcaagttttgcatgaactcttctgcagtgggcttgtccccatccacaatatctgtcacagctttgacaaagatagctgggactgataataaatctgcaacatatgccactgctgctccctccatgtctttgacagtcgcatcatttgccagaattgatgcttcatcctgaggagacatatctaaggaattgccagtcgacaacctcccaaccttcaagttaacttcttttaggaggttcggagtagaaaatgtttgcctagatccaattccatataaatcaaagacaggtatagggattcttctgtcatga

SEQ ID NO: 881 - DNA, 454 bp, Musa acuminata
  misc_feature (168)..(200): n = any nucleotide
tatttactacctacatagacaacagcaaggacatcggaagcctagcgatcgttacacaacactaaactaaatcgatcgaaccgaaggagatggaggagatctgtcatccatcttcatgcacacgactcctccttgacgtgaatggcttgtgggagatactgcgccatnnnnnnnnnnnnnnnnnnnnnnnnnnnnnnnnnaatggggctcactcttttgcaggccatgatgagctcgccggagagggagatcaccgggaggttctcgcagttgcagatctcgatcatgaagccgtcgggatcatggaaaaacatctggtccacgtagatcccgccttcctccactcgactctggatgtaaggtatgcccatctccctcagcttcttctccaccaaggccaagctctcgcactggaaggagatatggttgtccttggggttaatttccctcttcg

SEQ ID NO: 882 - DNA, 598 bp, Musa acuminata
  misc_feature (4)..(5): n = any nucleotide
  misc_feature (8)..(8): n = any nucleotide
  misc_feature (13)..(13): n = any nucleotide
cccnncgngatancattctcagtgacagtttttattaaggttaaattgatcagctcacaaagctatcgttacaacaaatcgagcaaaatgatacaacagttcggtcccataggcgaataggaattgaatgccacaaagcaagcaggtgtcggtagagctctaactaacatgagcaatgtctgtgtcctccggaatcttgaatgtctctgctgcaccaaatttcctcctccctccttcccactcatcctcggattccggactgctgtccccgtcatcatgatggctcgccgatgatggtgtcaaggggtcatcgatgctcttggagatgcagttgtgggttgcaagcattttgacctgacggagatgagagatctctacgacaaccgtgtcgtcatccaccggtagaggctgcttccatggctccccatcgattcgcatgaatgtgtgatccgctgcacccttgtggaactcgaaccgaattcttcgtgcctgtgcaagacgggttccatgcccatttggggtgaacaaaacaagcccatgccatgcgtcccggaaaccgacaacctcaagaaggccgtcatcaacataaggtggagta

SEQ ID NO: 883 - DNA, 513 bp, Musa acuminata
  misc_feature (21)..(22): n = any nucleotide
  misc_feature (24)..(24): n = any nucleotide
  misc_feature (497)..(497): n = any nucleotide
ctttattgaaaagaaatgacnncnttcatatactaaacgcatctcctaatggagaagcacagaagattgtaccatcaaatcaaggtcaaaagctccaatataccacatgagtagaaacggatggactatgcggtaagcctacatataagctttaaatcgattatcacgtctcagagagatagtgaagataaaaccaattcaagcagtacacccgtaatgcaaaacttgccgatgttcgagggggagacgttagacggggctgaggagctgatagagctggggtttgggctcggagttcataccgatgacgatgatgagggggatgaagccgtagtgggtgatcaccttggccttcttcatcgcccaagtgctccactccttcacgcacttggccgccgacgacccctcctccgaacccttggaccccttcccggccttccctttccctttgagcgaagtcttggcagccatggttcctctcgcccttttccttcgcntacaaccctagcttcg

SEQ ID NO: 884 - DNA, 346 bp, Musa acuminata
  misc_feature (8)..(8): n = any nucleotide
  misc_feature (198)..(198): n = any nucleotide
  misc_feature (233)..(233): n = any nucleotide
  misc_feature (238)..(238): n = any nucleotide
  misc_feature (244)..(244): n = any nucleotide
  misc_feature (247)..(249): n = any nucleotide
  misc_feature (255)..(255): n = any nucleotide
  misc_feature (257)..(257): n = any nucleotide
  misc_feature (260)..(260): n = any nucleotide
  misc_feature (263)..(263): n = any nucleotide
  misc_feature (265)..(265): n = any nucleotide
  misc_feature (276)..(276): n = any nucleotide
  misc_feature (279)..(279): n = any nucleotide
  misc_feature (283)..(283): n = any nucleotide
  misc_feature (293)..(293): n = any nucleotide
  misc_feature (299)..(299): n = any nucleotide
  misc_feature (307)..(307): n = any nucleotide
  misc_feature (310)..(310): n = any nucleotide
catctcgngccttgtatgggtagtcctcatcggtgtcgataccaccattgttgatgatgaactcaaaggcataatccatgagccccccgttgcagccctggttgtagtaggtgtcacagtccaccaattcctgctcggacagagagatcaggtcgccagtcatgatctggttgataccttccacacaacatacgagcngaattggtggactgtgacacctactacaaccaggnttaangggggnccnnngtgatnangcnttnanttcatcatcancgntggnggtatcggcnccgatnaggactanccntacaaggcccgcgatggaacttgcgatacttacagg

SEQ ID NO: 885 - DNA, 324 bp, Musa acuminata
  misc_feature (6)..(6): n = any nucleotide
  misc_feature (12)..(12): n = any nucleotide
  misc_feature (15)..(15): n = any nucleotide
  misc_feature (24)..(25): n = any nucleotide
  misc_feature (35)..(35): n = any nucleotide
  misc_feature (159)..(159): n = any nucleotide
  misc_feature (206)..(206): n = any nucleotide
  misc_feature (211)..(211): n = any nucleotide
  misc_feature (288)..(288): n = any nucleotide
taacgncaactncangatcccttnntctttaagcnaaacaccaaaaccagaagagatgctcttgtactttgctgggtcgatctgcatgttgcacttaacgaggtcgagcggggtgacggccgtgtgagtgaggccgcagctggcaatcccaccggcggngcaggcggcgtagaacatgggcgagtacatctcgatcttcccgggcncgctnggcgcctggatgacaaacgagcctgtcggagcgcccccgccgggcgccgaggcgggaggggctggcgaagcgggggnggccctcccaaggatctgcttcaggccgagggttct

SEQ ID NO: 886 - DNA, 640 bp, Musa acuminata
  misc_feature (469)..(469): n = any nucleotide
  misc_feature (472)..(472): n = any nucleotide
tttaagggcaaaactgaaatagttgttaaatatcacaattcaatctagaaacaagcgacagttggcctaaaaaggctccagtcagaaatattcattaaggtaaataaagaagatcaattgtatttggtaatctcactgcgacttcagaactaagaaaaaacccaaggtgtgagaaccgtgaaagtttcacatccaccagagagctcaacgatttgcccttggcaacacgttcgatctcatccttcttcttaatagcatagctgttggaagaacccttagctgcattaattaattcgtcagcaaggcactcagcaatagttttgatatttctgaaagcactttcacgagcaccagttgtcagcaggtaaattgcctggttgacccgtctcaatggtgagatatcaaccgcctgacgtcggacaacaccagcagatccaattcgagttgcatcttctcttggaccactgtnaanagattgcatcaacgataacttgaattgggtttgcatcagtaagcaaatgaataatctccattgtgtgtttaacaatgcgaacagccataagctttttcccattggttacgaccatgcatcatcaaagaatttgtaagtctttcaacattgggcactgaggcgacggcg

SEQ ID NO: 887 - DNA, 623 bp, Musa acuminata
  misc_feature (72)..(72): n = any nucleotide
  misc_feature (608)..(608): n = any nucleotide
tatattccttgttcggtgtcgtgggtacagtgaacgtgataaggaacatggatagaaatgtcttttcctggngtttcagagctgggccagagcagcgactacctcgaccatggcaggcctgtcgcggggtccatcctcggtgcagcggtaggccacgtccaggaaaccccgcacctggctctccatcgtctcttcctcccccatctcgcggtccaggacctccgggccccgcccctgctccaccatcccccgggcccaccgtcgtgcaggaacgccaaccccgccgccacacctcgcatgatcctcacccgagccggccatggcagccgccgcgggcgcccctcggcgtccggctcgtgcagccactggtccaggctgccgttctccaggtactcgtagatgagcacgtggtcgcggccggcgacgcagaaccccagcatgcgcgccaggttcgggtgccggatccgccccagggtgtccatctccgctcggaactcccgcacgccgtgaacggcgtcggcggacaaccgttcaccgcgaaccgtggcgcccgacgacagctgggcttgtagacgaacccgaagctgccgtccccgatgatgccgtcngggggaattctcgtc

SEQ ID NO: 888 - DNA, 620 bp, Musa acuminata
  misc_feature (14)..(14): n = any nucleotide
  misc_feature (18)..(18): n = any nucleotide
  misc_feature (175)..(175): n = any nucleotide
  misc_feature (218)..(218): n = any nucleotide
tttgcatacatgtntganagtaccacaagattggatcaccagattggggtgtgcttaacgaagcgcaggtcgaccgaggacggaggttaacgctaaacagggactgtcctgccgtaaggagcaggggaggaggtgtcctgctcctcttcgttctcgccggacatttcctccagcnatttgcccttcgactcgggcaccaggaaggtaaagataaggcncacaagattggatgccgcgagcacgaagagcgcgttgcggacgccgatgccggcagggtaccccttgtcccgcttcgtcggatcccggctctgcgccgcgtacaggaatccgaaggcgcccacgatggccccggccttgcccgcggctgccgagatgccgtggcatgtggaccgcagccgcgccgggaagatctccgccggcacgatgaaggtggtgctgttgggcccgaagttggcgaagaagaaggtgaacccgtacatgacgacgaagccgatgtggttgcccgaggtggtccagtgatggtaggggatggcgaggccgagcatgaacacggtcatgaagaagaagccatgagtggatggcgaaccggccatggtgtcatgaaggcgacgtgaaccagt

SEQ ID NO: 889 - DNA, 615 bp, Musa acuminata
  misc_feature (2)..(3): n = any nucleotide
  misc_feature (8)..(9): n = any nucleotide
  misc_feature (11)..(12): n = any nucleotide
  misc_feature (21)..(22): n = any nucleotide
  misc_feature (26)..(26): n = any nucleotide
  misc_feature (31)..(32): n = any nucleotide
  misc_feature (585)..(585): n = any nucleotide
  misc_feature (591)..(591): n = any nucleotide
tnnacacnngnnaggggaagnnctcnaccannaaagcgctcattctcgttggaggatttggcacccgtctccgtcctttgacgctcagtgttccgaagccactggttgacttcgctaataaaccaatgatcctgcatcagatcgaagctttgaaggatgtaggagtgaccgaagtcgttctggccatcaattatcaaccagaggtgatgctcaacttcttgaaggattttgagagcaagcttggcatcaagatcacctgctcacaagaaaccgagccactgggaacagctggtcccctggctctagccagggacaagctaatagatggttctggtgagcccttcttcgtcctcaacagcgatgtcatcagcgagtacccatttgctgaactgatccggttccataaatcccgtggcagcgaggcaacgatcatggtgaccaaggttgaggagccatccaagtatggtgttgttgtcatggaggaggaatccggaaaggttgatagattcgtggaaaagccacaaacattcgtgggaaacaagatcaatgctggaatttacttgttgaaccatatgtgttggaccncatcgnactcaagccgacgtcaatcgagaa

SEQ ID NO: 890 - DNA, 610 bp, Musa acuminata
  misc_feature (580)..(580): n = any nucleotide
attttacggtcacttcaactgacataggaagtcaactaacagggttcaaatttcagcaacaagctaggcaaaacacatccaaaactcaggaacttgtagcaacttagaaggtcatctcatggggcttgtcaccgtccctgagagagaaccgggcaccaaggtagttcttaaggtcagggacagcctcgatagccttgatcagctcagcatcgatggccttctggtcatcctttttgaaggatggcagattcttggtggtctccttctcagtctcgaacagctccccttcagtcttctttgccctggtcttcttgtccctggcgaagtacttgtcatcgaacttctccaccttaacaccagagatgtcaacctttgtggatgtggcaatcacataagcctggttcacccggcgaactggcacgccattgatcttgaaaggtccagagatgaggagcaggccagacttgagctgcttcaggaacaccacgcgcttccccatgtacctcccagcgagcaggatcagcaccgtgccgggtgtgatggtcgacctgagcttggtgggcttaggctttgcgggtgntaacggtgcggggcttgacgtcgtcggcgg

SEQ ID NO: 891 - DNA, 604 bp, Musa acuminata
  misc_feature (5)..(5): n = any nucleotide
  misc_feature (10)..(11): n = any nucleotide
  misc_feature (15)..(15): n = any nucleotide
  misc_feature (131)..(131): n = any nucleotide
  misc_feature (159)..(159): n = any nucleotide
  misc_feature (247)..(247): n = any nucleotide
  misc_feature (574)..(574): n = any nucleotide
  misc_feature (580)..(580): n = any nucleotide
aagcngccgnngatntcttcttttcatattcaatgaaagatgattacacggtaaataattatgcatcatgtctctccattgtacatttctacgtcaaaaatacgtacgtctctctgcacatcaaactcganatttcctgtgttcctcagattgcaagcntcaacaactttttagccgctaaggttggtggagttgtcggaaagcttggccctcctgctgatctccttctccagctcctccaagccgnccacttcctccagttccttgggtcccaagaagagcccatacggcaccccgtcgaacttgtccatgtggtgaatcttgtgggcggcggccacccggcggaagtaggggacgttggcgatggggcccacggggaacctgcggtggaccagcccgtcgtggacgaacatgtaggccatcccgaacagcgtgatcccgaggccggcgccgaagcagaggccggggaggaggccgcggttgaggaagccgtagccatgagggagatggcggggacggcgttgatgatggcgaagacgtcgttgagctcgaaggggccgtcgcccggccggtngtgaanactcgtgcatgttccacaacgatg

SEQ ID NO: 892 - DNA, 587 bp, Musa acuminata
  misc_feature (4)..(4): n = any nucleotide
  misc_feature (478)..(478): n = any nucleotide
  misc_feature (576)..(576): n = any nucleotide
cccnacgcgatggacaaaacgcgagccgagattgacgcacgcgttggcaacgggcgcttgctcgaggagtccgacctgccaagccttccctacctccactgcgtcgtcgccgagacgctccggatgtacccggcaggccctctcctggtgccgcacgagtcgtccgacgagtgcgtcgtcggcggcttccacgtcccgcggggcacgatcctgttggtgaacgcgtatgcgatgcaccgggaccccaagacgtgggacgaaccggcgaggttcatgccggagaggttcgagggtgggaagggagaagggaagtggatggcgccgttcggcatggggaggaggaagtgccccggggaagggctggcggcgagaatgatggcgctggcgctgggaacgttgatccagtgcttcgagtggggcagagtcggcgacaaggaggtggacatggccgaaggtcgggctctcactgcccaaagcngtcgtcttgaagcgacgtgtcatccacgcccaagcttgctcatctcctatcggagctttaggtcagttttgtgtattaagtcgcaggataagtactanttggtcttatc

SEQ ID NO: 893 - DNA, 576 bp, Musa acuminata
  misc_feature (4)..(4): n = any nucleotide
  misc_feature (10)..(10): n = any nucleotide
  misc_feature (421)..(421): n = any nucleotide
  misc_feature (556)..(556): n = any nucleotide
tatntctatntctgtagctctcagatgaagaacaagagttacaaatgcatcatcggaatgacagaacaagttcaggtaaaattttgcatggagcagccacaactcatttgctggtgctttgatctgtaccattgtccaaagcttcggttacacccacttcagctggacgaatgactcgatcatataacaagtatcccgacttgagaacaacagccacagtgcctggtggtttggaagagtccggtatttggaaagctgcaagatgcctgtgtggatcaaactgctcatccaaaggatcaaacttctcgactccaaatttcctgaacacctctacaagttgtttatcagtcatttcaacaccctcaagcaaggtttttataagtggcacagctccaacagagtctttggattcatctatctnttgaaaatctttctttgacaacagatgaagcccttccaagattgtcagcaacatctagtaggtcttggcaaaactctgtattgcaaattttttgagtttctgcctcacgtttgtcctgtcataacttttcaactncagcataactgcgagaactt

SEQ ID NO: 894 - DNA, 575 bp, Musa acuminata
gtaatgcaatcgagtgcgtcagaccaatcgagttcattaatattcaacctcatgaaggaaacatcagttaccttctgaggttaacaaagaccatctataagccgatggaacaattttatcaactcaaatcttggaagcaaatgagaggccttcctttgcaagttgttcgaggtctgtgacttggggttgcagccttgctaacttggctattgtcttggtctcatctggtgatccaccttccaggaaagcccccagcagctttccatctttgatccagtaggagccaaattttggtttagctgatgcagggtcgttgtcaccgaacataactgtttctcccacattgtctccatagaattgccatgacagatcaaaagagcgggaatagaagtaaggaagataatcatattcatcgattactttaccttcctcacttgccttgattgccttgacagcctgctctgctgattttctggcatgatcgacgtgctcgactctccttatatcattgtatagcttcatggggaaggtagctacgtcgcccacagcatacaccccaggaacacttgtttgga

SEQ ID NO: 895 - DNA, 574 bp, Musa acuminata
  misc_feature (6)..(6): n = any nucleotide
  misc_feature (147)..(147): n = any nucleotide
  misc_feature (432)..(432): n = any nucleotide
  misc_feature (519)..(520): n = any nucleotide
tcgatntattccattcagggaaaaggtgatctatacagttattgctctctttatttttctggtttgcagtcagcttccactttatggcatacattcaaccactggagccgatcctttttactggatgcgagttattcttgcatctantcgtggaactgtcatggagcttggaataactccaattgtgacttctggattggtgatgcaactcttggttggttccaagatttatcgaagtcgacaacagctacgggaggatcgagctcttttaaatggtgcacaaaagttacttggtattctaattgctattggagaggctgttgcatatgttctatctgggatgtatggcagtgtcagccaacttggtactgggaatgctattctcattatacttcagcttttctttgctggtatcattgtcatctgtttggntgaacttcttcagaaaggttatggtctgggttctggtatttctttgttcattgctaccaatatctgcgaaaatatcatttggaaggnntttagcccaacaaccattaacactgggcgtggtgctgaatttgaaggtgctgtt

SEQ ID NO: 896 - DNA, 568 bp, Musa acuminata
  misc_feature (6)..(6): n = any nucleotide
  misc_feature (478)..(478): n = any nucleotide
  misc_feature (528)..(528): n = any nucleotide
  misc_feature (539)..(539): n = any nucleotide
  misc_feature (563)..(563): n = any nucleotide
tatatngaacgtggacaggaaatatttggagagcagacatcctatttatgtatgtgtgtatgttttttgtatgtcatgaaacaaaagcaaaagggagatcagaacatgcagagcttaggaagatatgaagacactacaaagcctcaaaagaattgctgctcgaagaactgtgatggtggaaacaactccgtctctcttcctctcttcctgtcgccaccattaacaggcagcaatcctgatatgtccacaccgaacagcttcacaacccgaagcgggttaacagtaggcggcggggtcatcgtgcgaaagctcgcgatcacgtccgtcctccagtcgatgaacagctgcttctccggcccggtggatcgccagaaggtgaccacgtccccggccttgaggttcttctccctgacaaaccggctccagccttttgtcagcacgaagctctggctactgctccagtacgagtacctaaacntccacaccctgccgccggcgtctcaaagtgagagcacacccttcgatgcnacgtgctgcgntctcaacgggaaatacttctcggngtgtg

SEQ ID NO: 897 - DNA, 567 bp, Musa acuminata
  misc_feature (10)..(10): n = any nucleotide
  misc_feature (296)..(296): n = any nucleotide
  misc_feature (551)..(551): n = any nucleotide
caaaaatctntttaccatgtaagagaaaaagcagccacatagaacaagatgccagatcaccccgagaaggaagcaaatcaaccttatgatgcataaagatacacaggtgctacgactttcttacgttctcattcatgagggatatcctcttccacaagcatcgaatgacctctcatgccaggaatccaagcttctccccgttctttttggccaatcggatcaaccttgcctctgtttaccatcagcacctatagtcctgcagaactctgtgatcacctgtgaatggagagcgatanccttccccctgagctgattgaatcgcttgcgaccgatgatgttgcgaaccagcacgacgaccggcgcgaagaggcctttgccttgcgtgcgtgcgcgcgtccatggctgcctcgctgacggccgcggggtgcagagccctcccttcctccttccatggaagtggaccagtccttcgcgggtgaagaccgcgcagtttgggccaggcacgtcaccgtggtcttggttcgagctgctcggccgcggcggtattctangatgggaacgtgaacg

SEQ ID NO: 898 - DNA, 558 bp, Musa acuminata
  misc_feature (402)..(402): n = any nucleotide
aggagagagatggcggggaaggaatcgtcgtcggtcccgagcacgcctctgctgaaggatgaactcgacatcgtgatcccgacgatacgtaacctggatttcttggagatgtggcggcccttcttccagccgtaccacctcatcatcgtgcaggacggggacccgagcaaggagattaaggtgccggaggggttcgactacgagctctacaaccgcaacgacatcaaccgcatcttggggcccaaggctaactgcatctccttcaaggactccgcctgccgctgcttcggctacatggtgtccaagaagaagtacatctacaccatcgacgacgactgcttcgttgctaaggatccctctgataaagagatcaatgcacttgaacagcacatcaagaatctnctatccccatccactccatacttcttcaacaccttgtatgatccctaccgagtaggtgcagactttgttcgtgggtatctttcagtctccgagaaggtgctccgacagtgtttctcatggcctttggttaacattctgactacgatgctccacaca

SEQ ID NO: 899 - DNA, 545 bp, Musa acuminata
  misc_feature (3)..(5): n = any nucleotide
  misc_feature (7)..(7): n = any nucleotide
  misc_feature (19)..(19): n = any nucleotide
  misc_feature (47)..(47): n = any nucleotide
  misc_feature (53)..(53): n = any nucleotide
  misc_feature (66)..(66): n = any nucleotide
  misc_feature (70)..(70): n = any nucleotide
  misc_feature (83)..(83): n = any nucleotide
  misc_feature (187)..(188): n = any nucleotide
  misc_feature (340)..(340): n = any nucleotide
  misc_feature (353)..(353): n = any nucleotide
  misc_feature (435)..(435): n = any nucleotide
  misc_feature (492)..(492): n = any nucleotide
  misc_feature (529)..(529): n = any nucleotide
  misc_feature (532)..(533): n = any nucleotide
gtnnnanatcggggcatgnctggcatccaggtgggcaacgcctgctnggaacnctactgcctcgancacngcatccagcccgntggcatcatgcctagtgatacttcggtaggagttgcacaagatgctttcaataccttcttcagtgagaccagtgccggcaagcatgtcccaagagccatctttnnggatctggagcccaccgtcattgatgaagtgagaactgggacttatcgacagctcttccacccagagcagctcatctctgggaaggaggatgccgcgaataactttgctcggggacactatacagtcgggaaggaaattgttgatctctgcnttgatcgggttangaaactggcataactgcactggcttgcaagggtttttggttttcagtgctgttggtggtggaactggatctggtttgggttncttgctgctagaaacggttgtctgtggattatgggaaaaagtcaaagctaggctcancatatatccttcacctcaggtctctacagcagttgtnganncatataacagtg

SEQ ID NO: 900 - DNA, 539 bp, Musa acuminata
  misc_feature (6)..(6): n = any nucleotide
  misc_feature (10)..(10): n = any nucleotide
  misc_feature (53)..(53): n = any nucleotide
  misc_feature (55)..(55): n = any nucleotide
  misc_feature (78)..(78): n = any nucleotide
  misc_feature (91)..(91): n = any nucleotide
  misc_feature (136)..(136): n = any nucleotide
  misc_feature (327)..(327): n = any nucleotide
  misc_feature (508)..(508): n = any nucleotide
ctacanaganttgagtaattttctatacatcgaataagtagcatttatctacnanaaattgattgatgtggtggaganttgactcgttggnggcagtcaaagtctacgccggaatcagaagtctcgccttcttganggccatcgggctctgcacttcctcctcctccgccatggccacgcacagccggctgacatccaacgcgaactccgccgtcgccggtaggttcagatcgaaccccttgcggctcgagctggcgccctccgacgccgtcgacgcggtggccgacccgctgccgaggctcccatcgtagtgtctcctcttgtgcncgcccagcgcctgccccgtcgggaacgtcttgaagcacacggagcactggtgcactttgccgccggtggtggtggcgcctgctgcggcggtggaggagccggaagcggaagcgtccggggacgcggcggcggagggctcctccccgccgctgctggcgttgagttgcgtgctggcttgtgnctctagcgcttggtaggaacgaaggccttgc

SEQ ID NO: 901 - DNA, 519 bp, Musa acuminata
  misc_feature (7)..(7): n = any nucleotide
  misc_feature (11)..(12): n = any nucleotide
  misc_feature (217)..(217): n = any nucleotide
  misc_feature (257)..(257): n = any nucleotide
  misc_feature (341)..(341): n = any nucleotide
  misc_feature (349)..(349): n = any nucleotide
  misc_feature (370)..(371): n = any nucleotide
  misc_feature (376)..(376): n = any nucleotide
cgaaatntaanncgaagacatccaacaatcttagctggttttctaggtcctggcacgggacgttatttcaattgctaaaaggtcggggtttacccaacccaagtttcccagtgacaaaagtaaagccatgatgatactgaaaacacagggagtgtctctctctcacatgacttcagatattggattgctttgcgatcttgaacattcggtgtggaangacccgggcatgtcgaccctctcgtaggtatgagccccgnagtagtccctttgagcttggactagattagcaggaacactttccctcctgtaggtgtcgaaataggccagactggcagacatanctggagtncttatgccgtcgttgatagcnnggcanatgacacgacgcccaagcagcctggcgatccattatctctttgcaaactctgggtcgaccaagaggttcggtagctcagggttcctgtcataagcttcttgatacggtcaagaagatggcccggatgatgaggcaccttcata

SEQ ID NO: 902 - DNA, 518 bp, Musa acuminata
  misc_feature (3)..(3): n = any nucleotide
  misc_feature (437)..(437): n = any nucleotide
ganttccattactcttctttcctaatcacatcaagcattatggtttatatatacatacatgtacatttcttggtatggtcttcttgtttctgctgcaagtcgccttaaaccaagatcacgggccatcggtgaagggaactccggtggccggcaaccagctacctccagatagcaaacccctcacagtaaatctcagagcagtcgatggatcggtgataacatggtggccgcgccacctgactcgcctggaagtgtcagaccccggccctgtgttcttatactccccgtagtataacgtgttgagagcgaacccaccgctccattccaaccacccagctgcggagatcagatcatccatgtacgtacccatgaacacagttcgagagtaggcctgccatggccttcccaggtacgtccggaacttcccctgaaccggnctcaggtcggcgcggcgtcaccctgcagtgtggataacgatgccggtgttctggctgggatcggtccgcccctgcgcggta

SEQ ID NO: 903 - DNA, 508 bp, Musa acuminata
  misc_feature (94)..(94): n = any nucleotide
  misc_feature (96)..(96): n = any nucleotide
  misc_feature (101)..(101): n = any nucleotide
  misc_feature (104)..(104): n = any nucleotide
  misc_feature (115)..(115): n = any nucleotide
  misc_feature (118)..(118): n = any nucleotide
  misc_feature (465)..(466): n = any nucleotide
acgctccatacaattccattagtcttacaggcagaactcataaaactattgctgccagaaacagcaagcataaatctgaagatattgtttccangncttantgnacatttattanggnattaggaacggaagatgacaaaattggccaaccctaacagatggatacatgcaaaagatgcttgaagaaggcaaaatctataccagggtctccatttgtcacttgatgcgagcaactgctgcatgaatggcatcagcaagatgagggacagttttggagctcaaaccagccatgctgatcctcccatcagaagtcatgtaaatatgatactctttggtcatgaaggtcacttgctctctattaagccctgtgaaagtaaacattccaatttgtttgatgatgtgactccagtcaccaggcgtccctctagtacgtaaagcatcaaagagctgttggcgcatcctgannattcgatcagccatagctttcaactcaatagtccattcgtgg

SEQ ID NO: 904 - DNA, 493 bp, Musa acuminata
  misc_feature (47)..(47): n = any nucleotide
  misc_feature (92)..(92): n = any nucleotide
  misc_feature (219)..(219): n = any nucleotide
  misc_feature (443)..(443): n = any nucleotide
  misc_feature (455)..(456): n = any nucleotide
  misc_feature (477)..(477): n = any nucleotide
tccgatttattgtcgaatctgacttttacgatttgatattgcaccgnagacatacatgtttaagtatgatactgtgcatgggtcatggaagnatcacgatatcaaggtgaaggactccaaaactcttctgtttggcgagaaacaagtcactgtctttggaattaggtagtcttcttcttatcctttctgatatagatgttagtaatcattatgtttganacactgcccttgtttgtgtaataaagctgttctggtctttaggaaccctgaggagattccatggggtgaggctggtgctgagtacatcgtggaatccactggtgtttttaccgacaaggacaaggctgctgctcaccttaagggtggtgccaagaaggtcattatttctgctcccagcaaggatgctccaatgtttgttgtaggtgtcaatgaaaacgagtacnagcctgacattnncatcgctcgaatgcgagctgnaccaccaactgtcttg

SEQ ID NO: 905 - DNA, 484 bp, Musa acuminata
  misc_feature (10)..(10): n = any nucleotide
  misc_feature (41)..(41): n = any nucleotide
  misc_feature (55)..(55): n = any nucleotide
  misc_feature (82)..(82): n = any nucleotide
  misc_feature (89)..(89): n = any nucleotide
  misc_feature (98)..(98): n = any nucleotide
  misc_feature (105)..(105): n = any nucleotide
  misc_feature (108)..(108): n = any nucleotide
  misc_feature (112)..(112): n = any nucleotide
  misc_feature (120)..(120): n = any nucleotide
  misc_feature (122)..(122): n = any nucleotide
  misc_feature (144)..(144): n = any nucleotide
  misc_feature (195)..(196): n = any nucleotide
  misc_feature (276)..(276): n = any nucleotide
  misc_feature (334)..(334): n = any nucleotide
  misc_feature (352)..(352): n = any nucleotide
  misc_feature (386)..(408): n = any nucleotide
  misc_feature (461)..(462): n = any nucleotide
  misc_feature (465)..(465): n = any nucleotide
  misc_feature (471)..(471): n = any nucleotide
  misc_feature (481)..(481): n = any nucleotide
ccatgtgatnaatcccaattcatcaagccaactacagtggngacacagcaagccnaattgcttgctctggtgaaatctaagngggcttnttacagagntgttagnggnaggngaaagagngnaacccgacgcaaacgaagagcngaggagaggaggagattggcatccggttaagcactattaagtctggggcgnngccaagaagatgcggatctggtcgaggaaggtgatgtcctgcgggcgatccgcgcgcttcacgtaccccttggcctcctnctccgagtacaccttgtaccccgtctcctcgttccgcctccacagctcccccgcgtantccggtgggcgtagtatncctccgcgtccacctccgccgcctcctggctgcnnnnnnnnnnnnnnnnnnnnnnngagcatggggaggcgctcgtagtggcccttggcgggtgccctcgagctcgtcnntgngggcgngggctcgggngga

SEQ ID NO: 906 - DNA, 477 bp, Musa acuminata
  misc_feature (9)..(9): n = any nucleotide
  misc_feature (381)..(381): n = any nucleotide
  misc_feature (419)..(419): n = any nucleotide
aggccaganatagtagcaatcaagtattatacaagagaaagatggaccgatccaccacgacactaagttggtccgccgcgcccctttattaacgagaacattcaaactatcaccaaaagcaacccgaagacgagcatcagacgtggaccgcgatgccatatctatcgacgctcagagaagaaggcttagaagtcgaaaccgccgccgtcgtcgaagcccgcatcgtatcccgagtcgtacgccgccgcgtccgacaccatatccccgatgaggaggccgccgagggcgccgcccaggagccccgcgcccagccctgccccgaacttgttcttcttcggcggcttcgcgggggtaccgcgctgtacccgtacccggccggcnggggtgggtatccgtaaccccccggaggaggcgcgtancgtactgcggcggtgggtacccgtatccggccggaggaggcgcgtatccatactgctg

SEQ ID NO: 907 - DNA, 476 bp, Musa acuminata
  misc_feature (3)..(3): n = any nucleotide
  misc_feature (6)..(6): n = any nucleotide
  misc_feature (15)..(15): n = any nucleotide
  misc_feature (19)..(19): n = any nucleotide
  misc_feature (29)..(29): n = any nucleotide
  misc_feature (42)..(42): n = any nucleotide
  misc_feature (50)..(51): n = any nucleotide
  misc_feature (53)..(53): n = any nucleotide
  misc_feature (55)..(55): n = any nucleotide
  misc_feature (68)..(68): n = any nucleotide
  misc_feature (124)..(124): n = any nucleotide
  misc_feature (128)..(128): n = any nucleotide
  misc_feature (241)..(241): n = any nucleotide
  misc_feature (246)..(246): n = any nucleotide
  misc_feature (251)..(251): n = any nucleotide
  misc_feature (289)..(289): n = any nucleotide
  misc_feature (355)..(355): n = any nucleotide
  misc_feature (357)..(357): n = any nucleotide
  misc_feature (373)..(373): n = any nucleotide
  misc_feature (382)..(382): n = any nucleotide
  misc_feature (393)..(393): n = any nucleotide
  misc_feature (396)..(396): n = any nucleotide
  misc_feature (398)..(398): n = any nucleotide
  misc_feature (407)..(407): n = any nucleotide
  misc_feature (447)..(447): n = any nucleotide
  misc_feature (472)..(472): n = any nucleotide
ctnctngtttctganactnggttaggccnttggttactacanaattacanntngngtgtttaccttcngactgcaatcccgtcagtttaaacgcctcaaaaactctgtgcttcaaaccttcagntgcnatctttgttccctgagtcctcgaaacaagggtcttcccgatgttcctgacgttgaagactgagggagctttgatgtcgtaccagtccttcttcgcgaagggatcgaccgcctncttcntcccncccttcttccccttggagatccgcttgttcttcccgancgccatcgccgctgcttctcctcctgcttaactctttacacttgcatcttggttgtgaccatcttngnatattttgttcttgcnaatgtcacnacgtagaaacntanangataatccntgaagctatacagaagatatctttcgacttgttggcctgnttctttcgaactccactatcatgcnttgt

SEQ ID NO: 908 - DNA, 434 bp, Musa acuminata
  misc_feature (384)..(384): n = any nucleotide
ttactaggtggtgtgacacgtctcactcgttctggtctatccatgactgactggaagttcactggaggactacctcccttgtctgaggatcagtggttgcttgaatttgagaagtatcagcagtcaccagagtacaagcgagtgaacaaagggatgactcttgaagatttcaaattcatttactggatggagtatgcacaccggatgtgggggaggggtttggggatggtgtttgcctttccatttatgtactttcttgcaaagggttttattacccggcaactaggactcagactctcggcactttttgcacttggtggtgcacaagggctagttggctggtggatggtcaaaagtggactagaggaacctccatcagagtangttcagcctagggttaagcccctatcgtcttgcaactcatcttacgtctg

SEQ ID NO: 909 - DNA, 428 bp, Musa acuminata
  misc_feature (18)..(19): n = any nucleotide
  misc_feature (243)..(243): n = any nucleotide
  misc_feature (260)..(260): n = any nucleotide
  misc_feature (285)..(285): n = any nucleotide
  misc_feature (319)..(319): n = any nucleotide
  misc_feature (369)..(369): n = any nucleotide
  misc_feature (371)..(371): n = any nucleotide
  misc_feature (377)..(377): n = any nucleotide
  misc_feature (420)..(420): n = any nucleotide
tcgaaacttttaacggannttcgccaagaacctggaacatcccatccccgtttaacaacatcccagtcattctcatagcggtccatggttacatacattcgaccaccaccggatgcaatttgtgcatcaatacctttctctcgtagcttagcaaggtcactctctagagtttccacaaatccaacacttgagccatccaaaacatcacggccatcagtgaggatatgtacacgtattcttttngcaccattctcactagnccctttcagaagcaactgcaactgntcaagccgagagtgaacacctccatcgctcaatnacccaatgagatgtaaagttccttgatcaagaggattctttaatatactnanagcctnctccttcatatatttttccagatgcaagtgcaggatccactancttagcac

SEQ ID NO: 910 - DNA, 428 bp, Musa acuminata
  misc_feature (6)..(7): n = any nucleotide
tttagnngagcagacacagagattaaaaacatactccaaatgttaaacatatcgaaaccattaacttaagcaaataggcgaacacaaagcaaagcacggcggttacttggaaacaaatcgatgactctcctgccacaatggcctacttagatctccgtctctcttttctctcctactctctatcgcccgatcgtttcgttcttcttccgatctctctcttcctgaactcgaagatgtctgcctactgcggccagtaccacgatgagcttatcgccaatgctacctacattggcaccccaggcaagggtatccttgctgctgatgagtccactggcacaataggcaagcgccttgctagcatcaacgtggagaatgttgaggagaaccgccgctctctccgagagcttcttttttgcgctcctggcgcc

SEQ ID NO: 911 - DNA, 425 bp, Musa acuminata
  misc_feature (4)..(4): n = any nucleotide
  misc_feature (7)..(7): n = any nucleotide
  misc_feature (55)..(83): n = any nucleotide
  misc_feature (106)..(106): n = any nucleotide
  misc_feature (109)..(109): n = any nucleotide
  misc_feature (137)..(137): n = any nucleotide
  misc_feature (142)..(142): n = any nucleotide
  misc_feature (186)..(186): n = any nucleotide
  misc_feature (232)..(233): n = any nucleotide
  misc_feature (270)..(270): n = any nucleotide
  misc_feature (273)..(273): n = any nucleotide
  misc_feature (286)..(286): n = any nucleotide
  misc_feature (322)..(322): n = any nucleotide
  misc_feature (330)..(330): n = any nucleotide
  misc_feature (352)..(352): n = any nucleotide
  misc_feature (367)..(367): n = any nucleotide
  misc_feature (413)..(413): n = any nucleotide
agcntcnttattgcccttcccctctctccgccatttaagcaaacaccttatatgnnnnnnnnnnnnnnnnnnnnnnnnnnnnngtattatcctagaacaccttgcngtngtggccgtcgccatcgaccgcataccangagangttcgagttcagcgccgagcagttccggcggatctcgccttggntgccggtgagcacgctgagctgtgcacatcttggtcatggagtacnngaattctccgaagaacatgtgctggcagagggcgaanatnatgacgaaggggnttcgtccggaagtcttcgtagaggccctggtccgangtgaacangccctcccggtggaggaggtcnacgtagtacttgttntcgaatgtgttgggcgtgcggatgtcgatgacggtggtgcttctgntgttgatgacgg

SEQ ID NO: 912 - DNA, 420 bp, Musa acuminata
  misc_feature (72)..(72): n = any nucleotide
  misc_feature (206)..(206): n = any nucleotide
  misc_feature (248)..(248): n = any nucleotide
  misc_feature (371)..(371): n = any nucleotide
tgaaatgacgtctcattggattccatgagcaaatcctgcaaaatttgcgaataaaaataagtaatcaacaanaacaagaagcaaaaactgcatcaactgcttttaatccagctttgcaatgactgcatcaacgacttcttgggtcgtgctgcttcctcccaagtctttagtcctgtacttgccttctgctattacgcgcttcacancggtttcaagccggtctgcaaaggatgggaactgcaggtgcntcaacatcatcgcagatgatagcagcagggccaccgggtttgccttctggtgctccacaatcttctcattccctacgttgcctgctgaagcaccttgctcaaacactgcatgatcttgaccancattacctcctggcatgacaccagtgcctccagcaatacctgcagctgt

SEQ ID NO: 913 - DNA, 414 bp, Musa acuminata
  misc_feature (402)..(402): n = any nucleotide
  misc_feature (411)..(411): n = any nucleotide
cgaaagtgagtcatcatcatacaatctatccaatgtggcatcatagtttcttacacaggtcctcaaaacgatgggacgacaccaaaccttgaattagctaacacagcagcagtggagaacatctgatccacttcgagctctacatccgacttcttcgcaaaccggcctttgattcgtggcctcgtttcagcatacggcctttctcgatgcataccttatggtcttctcaaacctcctcgtcttcctcttctccctgtatctaagcactctggcttctctgtccatgagattgagctgtggttgaacttgaagaggatggtggcccgagaagagatccatggttcctttgggcgctccgatggaagtgtctggtacgacacttgcatccatggatgacaaagnaactctgtngct

SEQ ID NO: 914 - DNA, 499 bp, Musa acuminata
  misc_feature (445)..(445): n = any nucleotide
gggccatgtatgtagctaagcttttattgaagacttcctccgcaacttctacagtcaactcacggagtcgctatctcagcagtagcgtttattgcgttattacatggattcgtcacagtagtatcggactaagtaaagggactctggttgtagcagtccaagttgtctccgtagctcacccccagcaagtcgcagtacctcttgtagaagccgatcctatccgccaccctggcatcggaccctttcccgcactccaaccctccattgatgatgttggtggtgacaccgtagcccggaagccttccggccgcccggtcggcgttggatggcgtccagctcccggttatcacgtcgtggcacgacggcttgggcgactgaggagtcatccagaaccacagagccgtcttgaaggagatggtcgggtcggtggccaccaggtctgggntgttgagcaggtcggagccgatggctctcccggccggcccgtagttgtagttga

SEQ ID NO: 915 - DNA, 605 bp, Musa acuminata
  misc_feature (462)..(462): n = any nucleotide
  misc_feature (578)..(578): n = any nucleotide
  misc_feature (589)..(589): n = any nucleotide
  misc_feature (597)..(597): n = any nucleotide
aacagaaccatccatcttgatctaaacaaagtcgccaacacgtttggaggaatccatgtcttatgaactcgagatcaaagaagaaaaggtaacgaaaagctagcttcaaatcgaaaacaggataaaagacacacctatcccatttcccgcaccgtcgagctcgcgcttctcatatccagtccgatcaaacagcgaggaaggtcgggaaagactggcacctgttcggttgcccacgcccattgagctctctcctttcggcattcatcgttcgatgtatccgaactgggattaggggtgggcggaggatgtcaagggggagggctggttgttgacgatgaacgggtgctggaggagctgcaccgcggtgaggcgacgcgccggttccttctggaggcagtaagagatgaagctccggaactcgcgggaggcggtggatggcgcctccggcggatcagcgtacangatggcgcacatgagagacgcccaatccccctgccggccgaagttttcgccgaagggaagcggccgaggtaaaactcgaggatgctgaggccgaagtccagatgtcgccggcgtanttcgtagatancgtgggtnaagtcgtg

SEQ ID NO: 916 - DNA, 590 bp, Musa acuminata
gaatgtatttacatatcttgtatctgcttcttcagatgtcagccacctattacaacagaggatttggtcaacgatgtagaatacctgccattttttcggaaacaacgtgcgtggcaagagtaggaagaatcagctgtagcagaagcgatgagcacgagtaactccataaccattgtcagctttaagttctttcctaagcattctctacggtatgatttttgcttatcagtgtgggtgtcactgaaacaatccctataaggaacagtgtcgctattgcttggaaatcataaaggtcggccacggatctcaactccccaagagcaattccagccctgactgtcacgtaagcagctgggatgagtccaatgaaagttgccatgaagaatatgcggtatggcacatccactatgggtgaagcaacattgatgaaagtgtttggcagtgttggcgtgactctgagaaagagcatgtagttcaacagcttctctcttctttgggcaacctgttcttggaagtaactcagcttgtctggccacaaggagaagaccaggggcttccctatcaaatatgacaggaaataacatgaagag

SEQ ID NO: 917 - DNA, 1126 bp, Musa acuminata
  misc_feature (812)..(812): n = any nucleotide
  misc_feature (814)..(814): n = any nucleotide
  misc_feature (829)..(829): n = any nucleotide
  misc_feature (844)..(844): n = any nucleotide
  misc_feature (846)..(846): n = any nucleotide
  misc_feature (850)..(850): n = any nucleotide
  misc_feature (853)..(853): n = any nucleotide
  misc_feature (872)..(872): n = any nucleotide
  misc_feature (881)..(881): n = any nucleotide
  misc_feature (887)..(887): n = any nucleotide
  misc_feature (891)..(891): n = any nucleotide
  misc_feature (910)..(910): n = any nucleotide
  misc_feature (912)..(912): n = any nucleotide
  misc_feature (920)..(920): n = any nucleotide
  misc_feature (926)..(926): n = any nucleotide
  misc_feature (934)..(934): n = any nucleotide
  misc_feature (936)..(936): n = any nucleotide
  misc_feature (940)..(940): n = any nucleotide
  misc_feature (946)..(946): n = any nucleotide
  misc_feature (950)..(950): n = any nucleotide
  misc_feature (955)..(955): n = any nucleotide
  misc_feature (966)..(967): n = any nucleotide
  misc_feature (973)..(974): n = any nucleotide
  misc_feature (994)..(994): n = any nucleotide
  misc_feature (1007)..(1008): n = any nucleotide
  misc_feature (1010)..(1010): n = any nucleotide
  misc_feature (1014)..(1014): n = any nucleotide
  misc_feature (1020)..(1020): n = any nucleotide
  misc_feature (1030)..(1030): n = any nucleotide
  misc_feature (1081)..(1081): n = any nucleotide
  misc_feature (1105)..(1106): n = any nucleotide
gccatcagcatttctcattacttccaaatggaagaaacgtccataggtgaaccagcaaagatgggaagacaaaaggtgaaaagcaaaacgaacatagccatcgcttaaactctagtcgaaaatgccagtgctccgatttattatcatcgtctctttgcgtaagcaaccctaatacctgtagtgagcaggcttgtagggtccttcgatcgggacgctaatgtaatcagcctgcgatggtgtaagcttggtgagcttggcacccagcttgccgaggtggagcgctgccaccttctcatccagatgcttgggcagcacatagactttcttctcgtacttgccggtcgccttttccttccataattccagttgtgctatcacctggttggtgaaggagcaggacatgacgaagctgggatgcccagtggcacaaccaagattcataagccgcccctcggcaagcacgatgatgccggtcttggtctcagggaacacccagcgatcggtctggggcttgatggtgatgcgcttgacgcccgggtaggtctccagcccatgcatatcgatctcattgtcgaagtggccaatgttgcaaaaatggcattgttcttcatcttcttcatgtgatcaaccataataatgtcttgttcccggttgtcgtcacaaagatatctgcctcggagacgacatcctccagagtgagaacagggaggccctccatcagtgcctgaagagcacagatggggtcgatctcggtaacaataacaccgagcgccagcttgcttcagggcaccagcacagcccttgcccacatntntttagcccgcacacnacggcaacttttccngnaatnatnacatcaatggccctcatgnggccatcanggaganagtngctgcatccatacaggttntnaaactttntcttgntaacggantngttnacgttnattncgggnaagagcagggnnccgctnncctgcatctggtagaagtcncttgacgccggtnntngtcncctccnacacgccgangaggcgttccttcatcttgcggtacttcttggggtcgaccttgagcccgtngcggatgatccccagcacgatctnnaactcggcgttcaccgtgga

SEQ ID NO: 918 - DNA, 498 bp, Musa acuminata
  misc_feature (17)..(17): n = any nucleotide
accgacgacgcacacancataacaaaacaaagaagccatcagtcctactcacatgaacaaccaagaatggaagaatcttgtcgggatgagcatagcaacagcagcagttagacgtccgcctcgcgctttgggtcgccggccctcggcggcttccggatctggcgcctggacctccggcgctccctcgggtacttggtctcgccccactcgaagaacctgctctgctccgacggaatcacgtcgcagtccgggaacgtgagcgggtaccggttggtgtcgtagcagaaggcgtaggtcatatagcgctcgcggaagggcgcatggcggcacgcttcttgggggtcatcaccgcgaagtcggccgtcaagaggtcttcgttggcctcggagcaccgcctggcggagtccggctgctggatggggtcgacgcggcagccgcggaggacgaagtcggagaaatcggagacgaacggcgcgtacttgtagttcaccttgtact

SEQ ID NO: 919 - DNA, 416 bp, Musa acuminata
  misc_feature (7)..(7): n = any nucleotide
  misc_feature (11)..(11): n = any nucleotide
  misc_feature (13)..(13): n = any nucleotide
  misc_feature (19)..(19): n = any nucleotide
  misc_feature (25)..(25): n = any nucleotide
  misc_feature (30)..(31): n = any nucleotide
  misc_feature (399)..(399): n = any nucleotide
gatagcnacananaaggcnatcgcngcagnngcggatagagatggatggatcaatggcgacggacgaagtcgttgatggcggcgattagctcctccgtcctcttggcggtggttgggtcgttgtcgacggcgaacttgttgaggtagaaggagtggctcactccctcgcttatcactacggccacttccttccccgccttcttcatcgcctcgcagtactccaggttggtgtcccttatcaggtcgcggtccgccactcccaccaggaacggcggcagtctcaccgtctccagtggcggcgccgcctcccccatcgggcacgtgtaggggtggtccttggtggccccctctggcagccccagagcgagtaacttgtcgagcatgtccagcgtgaagatnaccgagtcggaccggag

SEQ ID NO: 920 - DNA, 844 bp, Musa acuminata
  misc_feature (412)..(412): n = any nucleotide
  misc_feature (804)..(804): n = any nucleotide
  misc_feature (810)..(810): n = any nucleotide
ctgtcggagttctcacattatccaacccaacatccaacacaaataaaaattacatgcatgacagaattgttaataagaaaatggcacagcaaagggagtcacttgaatgcaacagtagcctgcaaaggccatcctaaggaacagcttagaagaaatggaaaaacccacacaaaccaagagataacatccgatagcttcttttcatcagatttttttctttgctgttgtttcctttaaaaacctttgttcatccttagagaagccattctagatgactttcagcaggcagccttggagaaatctttgctggatctgttgtacttcatatgactcatcacaagttgaccagctgcaagagctgagaggagagacagctccccagccagaactgcaccggccacgacagtggcgnaggcgtctgggcatttgcaccaggagactccaagcttgcacccttcacaccaagtaggtccaagcaggcagcctgggaagcaagttgagtcccacctccaactgtgccaacctcaatggatggcatggtcacagagatgtgaagatcctttccatcattcacagcttccatcatggtgatacagtgtgaactctccacattctgagctggatcttggccagtggcgatgtagatggcagacacaacgttgcttgcttgagcattgaagcccccaagagatccagctatggctgagccagcaaggttcttgatcgtgttgagttccactaatgcaggtatattggtcttcaaaaccttccttaccacctcctccttgatgattgctcacagancaccgntttaccccgtccttcaatccaattcactgcagca

SEQ ID NO: 921 - DNA, 602 bp, Musa acuminata
atatattggtcattaagaacttgataaataaggttaatgtgcttaaacaacactagcggaagtaacacttaaaggaggaaattgcaactcatatttttgcagcaaagaagagatcctcatcggacacaattagctgatgaagaaaagctgcatgctctgtctcgaagcaatcccaccgttcatcaaggatcgatctcgatcatgatgagagaccgagggagtaggggaacccagttcgcctccagccagctcgaccccgcgatgaagctcccgggcgtgaactccgccgcctcggctgcacttgtgatcaccttgtaccccttccactgcacccggctgccggtcccggcgccagcccccgtgttccggtactcgccgtagtacaaggtgtcgagcgcgaacgtcccgctccactcgtgccacccttccggctccgatcacgtcgctgatctccgactccattatcaccgtcctcgcgtactccttccacggccggccgaggtaggtccggaacgacccctgcacgggcgcaaggttgggcgccgcgtgatgcgggaccggtggatgatatcccggtgggctcgttggggtcgtcgcgcccc

SEQ ID NO: 922 - DNA, 597 bp, Musa acuminata
aaaaacacatggttacaccacttcatacatttattctcaagtccagtcattcctcactactgcaatacaaagacagttcactcgagtgccaaacaaactaagaattacagcaaaacgaatacaagccagctttatttagatcccatccacagtggacagagatgtacaggctcatcataactgttctacagactgagggccttgagagaatcacccttctgtttcaggctaaccagcaaactgtcgaaactcttcttgaatgactccacaccctcggcctcaagctgtgccccaacttcgtcccagtcaatccccaacttctctagtgcactgtaaattccctcagcctccgagatgtttgaatcaatggtcctcgagacgacaccgtgatccataaaggcttcaagagcctggtcgggcatggtcgaaaccgtgtcaggtccaataagaggatcgacgtaaagagtgtcaggatatgcaggattcttaacactggtcgaggcccataataacctctgctttttggcaccttctttaccaaagcctcccaacgtggacagaaatttcttttgtacagttataagtagagttgttgag

SEQ ID NO: 923 - DNA, 608 bp, Musa acuminata
  misc_feature (19)..(19): n = any nucleotide
  misc_feature (522)..(522): n = any nucleotide
  misc_feature (525)..(525): n = any nucleotide
  misc_feature (553)..(553): n = any nucleotide
  misc_feature (565)..(565): n = any nucleotide
  misc_feature (579)..(579): n = any nucleotide
  misc_feature (596)..(596): n = any nucleotide
tttctagaatcaagcgaanaaagcaacatatacacagaacagagtataaaagaactaaaattcatgaaaggctaatgaagaacgccggcaattattattgctgttgctgacgatgacaaatccatacctgattggcaaactcccagaagagaacccagatgacaactctaccccagagctctgccatcgcatagaaaaggcagaagctccaactcctcaagatagcaacggggccgaggaagctcgggccgagcgccgccggaagcttatccgcgagcgctgtggggtggatgacgctgatgaggggatacaagacgaacctgaaggcaatgaaagggacgataaccgtgtagaaaagagcctcctttgacagcacgttggcgagcttggtgtacagcagcatgaagcccaccgccctgggcaggttcacccacgtcttcaggaagggtatgatctccgcgccgctcccgttggccgtcaccaccaggacgtccttggtgtcgcgcaggaacgtgtagttgnagntatgcagaggacatcatcccgagggganttatcttcttangcgtcactaactcnacgctaagaactttggnttctctttatcg

SEQ ID NO: 924 - DNA, 605 bp, Musa acuminata
tacattgaaataattccaagaaagaattggtaactggtttatacaacctgatcgtacaaaacaggtttctgaatctggaacaggaaggagtaggatcaagcgtattttgtgtaacaagaagaaaacaagcctccaaattattgagggaacaacatctgtctagctgactaccagcttaattaatttatgggcaaaattaaaatcaaggtgaaaaaattcatcatccaacaatcgaaaatttgacagacgagcaaactggctttcgattgagaaggttcaaacgtagtagccagtaaaggtgaatcctcgtccaactatctcaccaacacaggaccatgcgtacagctcgagaccaaataatgctgctatgctggcttcctcgactttgagatcctttatgtttctccagatgtgcctcaggccatcaatctccttccagaatgattcgtaccgaccaggaatgcttgccagacgcgtgtaaaagagctgctttgacaactcttggcacttctcgacggaaggtggttgaacaatatactgcttgttcttctccagaagctccttatagtatgcgcaaccgttcttcgccacaaactccgaggctt

SEQ ID NO: 925 - DNA, 604 bp, Musa acuminata
  misc_feature (582)..(582): n = any nucleotide
aaccaaataacaatgtctaagagtaagaatagagtggcaaaatgtagaggatcctataaccatgattatggcaattatttcatcttccacttatgtccaaagagaaactggcatgcaagtgataaaatttgaggcaaggttctaatccagtaaacaaagagccctataacaaaattcagatggatgcagagcatagaactaagcagtggcagttgcgccagcagcagccaagcgctttcgtgcctcctcaatgatgctgagcttgattcccttgccctttggaagagacacccatgggctttgtccccttgccgatcgtgaagacgttgcccatgcgagtcgcaaattcatggccagtggcatcttggacgtggatggtgtcaaagctccccttgtgcttctccctgttcttaatcacaccgacacgaccggtgtttctcccaccagtcaccatcacaacatttccaacatcaaacttgatgaagtcgacgatcttgttggtttccaagtcaagcttgatggtgtattgggccttaataagagggatcagggtagcgaatgggtacgaccatcatatgtgtncaggtagggaatgcccttctgt

SEQ ID NO: 926 - DNA, 487 bp, Musa acuminata
  misc_feature (7)..(7): n = any nucleotide
  misc_feature (9)..(9): n = any nucleotide
  misc_feature (75)..(75): n = any nucleotide
  misc_feature (86)..(86): n = any nucleotide
  misc_feature (182)..(182): n = any nucleotide
  misc_feature (429)..(429): n = any nucleotide
  misc_feature (462)..(462): n = any nucleotide
  misc_feature (466)..(466): n = any nucleotide
caaatcngnttactttctcgttctacatgcgatcgtgaatccaacgtcatacacattttgacttattgtcacaantccaattaggnatctatacgtaaacacccacccctttctttgacttcttcgacttccttttgggacccaagacgtgtatcagttcaccctcctgcagttcgatctgntctctccgctgcttcccgtcagcgggctgatgttccccatcttcaccatggccgccgcgaagtcggccgcgaaactgcagcgttggtgctgtactgctgcaccagcgcgtcctgcgttccattgttgaagagctcctgatccgagtggaggagaccccgcatggcgatgaggttccggtagtacgcgttgtcgaaggtgttggcggtctggacgtcgagcggggccaggttattgtcgccgccggangaggggcagttccgctggcgctgggaggcgaancggncgtcgacgttggcgtcgttgt

SEQ ID NO: 927 - DNA, 371 bp, Musa acuminata
  misc_feature (9)..(10): n = any nucleotide
  misc_feature (174)..(174): n = any nucleotide
  misc_feature (190)..(190): n = any nucleotide
  misc_feature (308)..(308): n = any nucleotide
agtaatgannccactattcctagaggattccacacctaaattacatgaagcatgcatacaacttttgtgaatatcaaacgcatatgtgtccatcagattagaagaaacgaattgaatggtaagtgtgttacacctccagcatcatatgattggggacgttccgatggtatgacnagatccatttagctgncgacttaacccaacagcatagtcacacatgtcaataatttcttgaacttctcccaatcccttcaggaagaattttcccccatctcaaagcggagacaagcctaccaagggtattggangctttcctcttaatgcttcaaccaatctgtctaacaatttctcccccttttggggagctggaa

SEQ ID NO: 928 - DNA, 550 bp, Musa acuminata
  misc_feature (6)..(6): n = any nucleotide
  misc_feature (61)..(82): n = any nucleotide
  misc_feature (138)..(138): n = any nucleotide
ttaaanttttaatttcaagagacaataaagaaaagaagtacatatttaagagcttcttatnnnnnnnnnnnnnnnnnnnnnntgggtgtggctgtaccagtaacagctcaaagtataatacttatacgtatgactcanccgacgaggtcttcctccttgtgggtctcgatgacgacgtcggacgtggggtaggcgacgcaggtgagcacgaagccggcgccgatctggtcgtcgtcgaggaagctgccgtcggactggtccaccgaaccctgcaccaccttgccggcgcaggaggagcaggagccggcgtggcacgagtaggatagatcgatctccgcctcctccgctgcgtccaggatgtacacgtcgtcggggcattctatcaccttctctccctctggcgtcacaacttgaccttgtagacgggccatggcggtcacccggccccgcccggcgtccaccccgaagagggagcggcccagcttgggcagggcgcgcaggctcacgccgggcgctctgccgcagcgcgaaggggcgtgccgagggagag

SEQ ID NO: 929 - DNA, 495 bp, Musa acuminata
  misc_feature (5)..(5): n = any nucleotide
  misc_feature (247)..(247): n = any nucleotide
  misc_feature (390)..(390): n = any nucleotide
  misc_feature (477)..(477): n = any nucleotide
  misc_feature (480)..(480): n = any nucleotide
attcnagtaatacactcttttattgatgttgctacgtgaactcataacacccacatatttcgacatcattgatacgtcacatcgccacgactcatacgtcgcaagttatccacaaaggctcgtcgaactggccgcgaagttctccccgacgttgggccccagcgaaagggaccccagcgacggtacatcgccacccgagtgccacgttggcgtcccgttctcgtagcagttataggtgaggcgcgtnaacccggtcccgttgagtcggcacgcgtacaggtccccgtaggctggaagtggttcggcaacgagactggctcggccgtgacggcgccaaggttggccgcgaatacaagccaccacgagtccgggctgaagcacacgtggttnagcctctccctccccacctccgctgaccccggcggccctgccacgtgcacccgccgcagccccgtcccgtccggccgcaccaggtanatnccgaagacgtccggg

SEQ ID NO: 930 - DNA, 551 bp, Musa acuminata
tatcttttgtgatttcctcagactacaatgcatgtgtcctctcctggatcaccttcactccaccattgacgtcacacagacatatgagctaacactagtcgaccaaagtcaacgaaagagaggaagcgtcggggtggcagtcctctcaagcctctgtccctcaagagaggatggagtgcagatcgttaggtcgaggttgagatcaggcaacacagtggagctgcacttcttcatgttctcgtggcttgtcacggcatcagtcgacagagatgcactgtgtgagctccgagatcgacggagcggcgccttctgggtcaaccggtggttgtcaggatcgacacccatgctcttgagcttcttcctcaggtgggagttccagtagttcttcacctcgttgtccgttctccccggcagcctcccagctatcaacgaccaccggttgccgagcaacgcgtggagttgatgatgaggtcggttcatcctctttaaagttgcttctcttcacgtccggacgaaggtagttgatccaccggagcctgcaactctcgccg

SEQ ID NO: 931 - DNA, 464 bp, Musa acuminata
attttatatccctttaccagaaaagcctgcagataactggcaaataaaggatggcaagaaaaatatttcctggtgcatatttccagtacaaagcaaaacacttatttgcatgcgttggtccgcatctttacgttacaaactcatctcccaatgaaagactgcagtgtgtagaactagaaattattcctcaagcaaatcaactttagtccggtaaaaaaggaaagccgaaatcaaaactaggcagtttaacatcaggctcttccgttttagtagggctccacaggtgctcggaactttgctcccgcatagacggctgcagcaccaagctcctcctcgatcctcagcaactggttgtacttagcaaggcgctcagagcggcacggagctccagtcttgatttggcccgtagctaaaccaaccgagaggtcagcaataaaagtatcttccgtctcaccactccggtg

SEQ ID NO: 932 - DNA, 943 bp, Musa acuminata
  misc_feature (43)..(43): n = any nucleotide
  misc_feature (85)..(85): n = any nucleotide
  misc_feature (89)..(89): n = any nucleotide
  misc_feature (93)..(93): n = any nucleotide
  misc_feature (156)..(156): n = any nucleotide
  misc_feature (158)..(158): n = any nucleotide
  misc_feature (241)..(241): n = any nucleotide
  misc_feature (389)..(389): n = any nucleotide
cctgacacccttgaaggcttaacgcatcgggatacaaggaggnagacaaaactaaactttaaccggttcccttctattcgaaganctanaagnaaatggtgacttctggcctgctaaattttggcttagaccatatcttctgttggtgtaaaaatntnatgaatgagttttctttggtccataatgcaggttgaagagctgctcaaagaatttgacaatgtctgcactcttagagttagantgccaatatcttctgatctgagcaatcctcgcaacttcatcacaaaaatcagtcgctacaacaaagtcgtgaacataccaaatagcatgacagttttagatgaacttctgcccatatcaattgagatggcaaaaagaagctgcagggncatatggaacttcaccaatcctggcgtggtgagccacaacgagatccctagagatgtacaagagctacattgaccccagctttaaatggactaactttacattggaggaacaggccaaagtcatagttgcacctcgaagcaacaatgagatggatgcttcaaagttgaagagagagtttccagagttgctgccgataaaagattctatcatcaagtatgtctttgagccaaacaaaaaggtcctttctaactgagaagcttatcggtgatcgcattcggtctagacttctgtattaaagcagtagagccccaaattttccacttaattactgatgttggccagtattatggcagcaagactatcatcagatctgctcggtggtggcgtctagaagactctttttctacaagggaggaaactgcttgtttcaatttgattaggtagtttcttttgcttttcttgtttagggtctttacaagagaccaacattatttgttttctcaaattggtttcttgtccaattttgtgtggcatgtactcattaacattcaat

SEQ ID NO: 933 - DNA, 472 bp, Musa acuminata
taataatcataataggctaatcaaggtttcggagaacagaactccacccgaaaattgtagggaggatctcccactaccaaaaattattgacgtccaagaatttctcgcacggagatgcatgtatactgaaataaaaatcgtcatcatatgagaaaaaatgacgatgcatccttaagcaccacctgaagcaagattgccaccaaaccatttccagtatccatccttgtctttcttaaaattaaacatcctcttgaagtaatccttaaaggcaaagttcagagcctgagtgggaaagtaacgaatgacattggctgtgttccctctccacagagacaaaacaccttcatctttaattgttcgggaaaagcagtctgatattcctttgtaaggctcagagaggcgcccagccttgatcatctcatcctgattttgtatcagaagtttcacacgctcaataggagcagcagctgtc

SEQ ID NO: 934 - DNA, 333 bp, Musa acuminata
gtcgtttttatttcatatatcaaatggcatccacatagtaatagatgataccaggcacatcaattgcagcagcatgatacttccgaaattcctcctgtcccttggctgaacggctacctatagcgacaccatatgtagaaccacgaggatatccgccaatgaatgcttcagggaaaacaaccaactgtgacccatatgaagcagcttctgcaaccagcctctctgccttatcaagggtggcgggggtgtcgtagaagacggtggaggcctgcacgacggtggcgcggacggtggaggagggatcggagcctcccatgtcgacctccgcgatca

SEQ ID NO: 935 - DNA, 617 bp, Musa acuminata
  misc_feature (8)..(8): n = any nucleotide
  misc_feature (162)..(162): n = any nucleotide
  misc_feature (164)..(164): n = any nucleotide
  misc_feature (590)..(590): n = any nucleotide
  misc_feature (603)..(603): n = any nucleotide
ccaatatntaaccagattgaaaatccatagagctactgtatagcattcatgcgtgatcttgagatcatagtaagtcccaaaacaagaaatataacgaaaggaaacatcttaaagcaaaaaggctttaaaatccacaggcagcctaaccatatcagcagcagnancagcagaagaactcattcgagcggcacctcgacgtcgccatcagatatctcctgctggaggtccttgggatccttcccatcgacggtgcacccgacggagacgcacgtgccaaggatctccttgacggtgccagcgagatccttggccatggacctgggccgcatgactcgagcgatttcgacgacgtcgtcgagcgagatgttgccattgtgtttgatattcttcgtcttcttgcggtcgcgctcgggctccttgagggccttgatgacgagggcagcggcggaggggacgaccgacaccttggcctggcggttctgcaacggtgagcttcacggtgactcgaaggcccttccactccttgggccgtctccttggcgatgtcctcgcccaccttcttcggggagagccccaaaggaccgatcttnggggcgaaggagnggcggcgcgaccta

SEQ ID NO: 936 - DNA, 584 bp, Musa acuminata
caaactcatattgctgaaatttaatttacatggcatagttcttctctctcagctacgattgtagcaggaaaaatgtcatgcggttgacatttgatgatgatgatgacattaattagaacaaattaatggggagagatgggagatgtacatagattgccgtgatcatttgatcctccggcagagggtgacgccgtcgccgacagggagttggcagatctcgatgcgggggtcggcggcgagagccctgttgaggtgcagcacgaagtcgcgatagtagcggacgtacttgcgcacggcgcgtcccggcggcgccaccacggacccgttccagagcgtgttgtcgtacgcgatcacgccgcccaccttcaccagctccagcagccgcttgtggtagttgaggtagttgtccttgtcggcgtccacgaacacgaagtcgaagctcccctgcttcttctcctgcgaccaaccacatcgacagcatttatcagcagagacaaggagtaatggttggaagatgcattccattctcacatcttcaagcagtagatcgagaacagggaggccgggctttcgcgaagtcgatc

SEQ ID NO: 937 - DNA, 537 bp, Musa acuminata
  misc_feature (7)..(7): n = any nucleotide
tggaaanctaataagtagtaatcaacagcaaggaaaatacaaagtcatcatgtcattggcttactcctcacaggacagatagtttcaggagtagcagttatttcatggttctacaatcccccttgtggcttaaagtagttattactgcgcgctgaggacttcgatttcaaagatcaagaccgagtttggacggataccccaatctggaaagccaccagctccataagcataatctggggtacactgaagtcgagcaacttctcccacttgcatatccatcactccctcatcccaccctttaataaccgagcccaaaccaactttaaatgtgaatggctgctgtccaggatctttggtgctccagaatttttttgagaggtcaccatccttaccgaagcctgtgcagtgtacggtgacggattggcccctgacgggcttggggccatggccggccttgaggagctgcttctccacgcccatttgctggggtcccaaaccctatcaaggtacacggtgacggctcttgggacgtcggct

SEQ ID NO: 938 - DNA, 451 bp, Musa acuminata
  misc_feature (4)..(4): n = any nucleotide
aatntagcatgtactttcatcaaggagagactctaaatcagtaaagctaatctaactaccaaataagaaagaatccttgtagttgactcaagcatctaataaaattttccatgaaaggcagtataaaagcacatatagtttgcctaagcttcagagttcatatatggatttctacaaaagaagaaaagcaactgaccttagtaaagaacttttgtgcatggctcctgatttgcacagctgtcttcgtaccaatatgctcttcgatgcgctgccaggccctcccatacagcttcagagcttcaagaaatcggttgtgctcctcctcagtccaccgctccctttgctttgtaattgtgtatggctttctcgtcttcacgacaaccacatcttctccagaagagttcccttccataccgaaatcttaaattcaagaagcagagcgaagacaaaa

SEQ ID NO: 939 - DNA, 582 bp, Musa acuminata
  misc_feature (206)..(206): n = any nucleotide
  misc_feature (213)..(213): n = any nucleotide
  misc_feature (218)..(218): n = any nucleotide
  misc_feature (225)..(225): n = any nucleotide
  misc_feature (400)..(400): n = any nucleotide
ttatataatgaagtagaatctgatgtttacatattaaaggaagccttttgtatcgtctatggatgtggtaattggcctttttacatatattatcaatgttgaggtacctgaacctgttggagaagttcctcaagttcaacagtaatttctgagaatgtaggccgtttagcaggatttgcctcccagcatctttgcatcaagtccangcaatgnaggangtgtttnctggggaagcacaggacgaagccctgcttcactcctagggcagcttgcagaggcgacatggactcatatgggatctttgatgttgcgagctcccagagcacgatcgcaaaactgaatacatctgctttctgatcatatggttgatgatttatgacctcaggtgccatccatctanatgttccagtttctgctgtcataattcctccttgattcagaattcgagcaacaccaaagtctgccactttcacaacaagattgtatccataaggaggttggtgtctttagatctctatgaataatgtcattttgatgtaaatagtcattccctgcaaacatcaatcgcaaacctcagaacat

SEQ ID NO: 940 - DNA, 634 bp, Musa acuminata
tcatcattttgctctaataatccactttaggtttcacaattgaaacaacaaaatcactcgatctaacgaagcacacgtatccactaactgcaaatccatccaacgaaaatgacacagtcactctttcgaagacttgttaatgagggacttgtgaatgtgggggatgactccaccaccagcaatagtgcccttaatgagagtatcaagctcctcatctcctcgaatggctagctgaaggtggcgtggagtgatacgcttcaccttgagatccttgctcgcattcccagcaagctccaacacttctgctgtcaagtactccaatattgctgctgagtagacagctgcagttgctccaacccgaccatttgcttgaatcctcaacttcaattgccgatggatacggccaacaggaaactgcaaaccggctcgggcagaccgggataccggcttcttcttgtccttgtccttgttcgccgccgtcgtccttgacggacatgagtcccttgatcccaccgcagcggctgtggccgatcaccattatgttctccaccttgagatggagcacagcgtactcgatggcgggcccaactccggcgtacttaacctggtcatagggagggaccatgttggcgcg

SEQ ID NO: 941 - DNA, 499 bp, Musa acuminata
caagaaatatcaggaccgcacctgacaactcagtttatttatgcaaattaaacaatcgttctagaaatgattgtaaaagaaaaactaatgcatccattagaacgcaaattcggataagtggactctcgtctgctcattactagataaatcgcagacaaaatgttgctacgacagatgagtagacttttgagtcaaaacgtttcacgcgcctttgaaagcagcaaaaatgtcaccgtgaatataatcattgtcaacaaggctaaccaagaagcaacttttttgcacctgagctagtagctcccttgatggatcaccctcaggaaacaatcgagcccatccccttgtccaaatctcaaaagcttcatccttccagatcatgaagctagcagggtccacaacagttggttggatgatctctttgccagggaaaacaccccatgttactgcattgactgcattgagaacaacattggagacatactccccttctttgttcaca

SEQ ID NO: 942 - DNA, 553 bp, Musa acuminata
  misc_feature (239)..(239): n = any nucleotide
atgcaaagtttcagcgtcaacaagcaagttcggacaagcttgacaaaaagatgaccaattcaaaatgaattaagttccagaacaaatcagctgagcaagggatcctatcgatatcggcgaagagacaaggtctggtttctcttccaggttgccctacgagatggcctagccttgtgatgaaggtggcctttaccgcgaagaccacggtacttcttgccagccgatgttagcccgcgaantcacggtgcttgtgaacgcccttgcagatccagttgatcctagggtcgttgcgaatggcactgtgggatggatcaataaggatgatctcgtaatatttgtatgttgaatcctcgttaacccagtaagagtttagcaccctgaggcctcccagcttgcgaccagctctctcctctgcaactgatcgcttgtttctttggaacttaagctgagtgataccttgatgcttgggcttcccataaacaatgcccttgggaactggtctcttcctgccaccacgtctaacacgaacacgataaatcacataaccctgttt

SEQ ID NO: 943 - DNA, 570 bp, Musa acuminata
  misc_feature (5)..(5): n = any nucleotide
  misc_feature (17)..(18): n = any nucleotide
  misc_feature (31)..(31): n = any nucleotide
  misc_feature (548)..(548): n = any nucleotide
  misc_feature (553)..(553): n = any nucleotide
  misc_feature (563)..(563): n = any nucleotide
aacantaccctggattnnatctaagcatcanccatggatctccttctcaagtcacatttattgtcatggcatgcaccatgttcttatcccaagaacacagtgtattattcttggagttattgagtgatcttagtaagggcgctgccccacatagttgcccggaggtttgtagttgcagatgatgaagatggcgccgctgttgcagcgcacacggccgcagccgatggccgtggacgaacgccacacaacctgcgtgtagtggccgcacaccttgttaggggcgcacgtgttgctgttgtagtcgtagtactgcttctcggagacccaggcgttgacggcgtctgccgccgtgtagtcgaggccggagccccagaagatgttctcgccgtacggcccaccggagtgcacgagctggcagtcggccgcccgctggttggcgtagttctgggcgtacgcgcgacggtgttgtcccacgacacgggggcgacgccgacggggcgcgggcggcgttgtgggggctcacgaattcctggggcgagtttgggtangatanccggtgcatncatggca

SEQ ID NO: 944 - DNA, 746 bp, Musa acuminata
tcaatgaaataattatgacccaaaatacttgtaggtccaaattgtgatccgttcaagtttcaagaaacttgtaacatactgataatgagtaaagaggggtgtttgttatatatcatcatgattcaactttctccaagatcagaattctccctttattttggtgctttatttcatgttttattcgtaggtaggtaggtaggtaggagatgattcatcaaccttacaagttagtttctagaagcttatttggtagacgggctgcttgttgggataaaacaggccaaagttctgctcgatccctccagccttctggttctcgttgaacatctcgaatatgtacgcctcgatctccttccctggtctcctcggcgttcctccgccaacatgcctgatcaagttctggttgtacgtctgcgcgttgctggtgctcgcttcggctcctccgcccgccgacggccacccgctctccgacaccaccaccgccacgttcgcccctcccactctctccagcgccgcgaagaccgcgtcgacgatggcgtcgaacaggttctgatagctgaatcgcccatcctgcacgacgacgccggaggcgtgaacagggcgtagggcagcgagatctgtcccgggttgccggtgtagctaaaataagggtacacattgaccaggagcggcgctccgttactcgccaagaactgcacgatggggtcagggtacgcctgggcggcggaggagaaggcgccggcgga

SEQ ID NO: 945 - DNA, 679 bp, Musa acuminata
attgcaatgaacgaatacatcaagaaaagaacaagtggcatcccaattaaaccgcttattatcgtacgtacgtctaccatacatgtctacctccttcttctttacagagagttcaatgagttctttttctttgttcgtaagcttaaaagttggagtagatttgcatttggtttagtatgtcctcgaagttgtcattgggtttctctatcggatggctatgcattccttcgtaggtcgtcaccacgatgctttcgtccctcgacagtcgctggacttgcttcttcacgttgcaaccttgatgcgtgcaccggtagtagcttctagggaacttgttgttcttcactgccttctgcccatacttcctccaacgatagccgtcgtcgagtatatccacttggctcctagtttggaaggcataccgcggccttctcaccttcttctccttcttcttgtcaggcctcgtctcgttctccatcgacgaagccaaggatttcatgtggtgagctccgtctccttgcgggctcatacccctgccctcaaaatccttcagccccaagagaccactcgagttgccaccgtggagactgccaaagacgtgggtgctgccgagatctcggaggttgtggaacgaagtagaagaggaagacgattgctgacaggaataggatgggtcttctca

SEQ ID NO: 946 - DNA, 625 bp, Musa acuminata
tacatttcatatattaactgcgtgaacaacagtcatgactacagtgtccttccaattattttccagacttatctgtctaatatgatgccagatgcaatcttcactgtatgatgaaatggctgaggcaaaagggatgagatcaaaaccatcccacgaacaagcaatgcattgtttcaaaaagaatttactcccaaaaatttggtcttcgttgacagaagacatttgtttcgatgaatgctaaacaatcaagcagctttcagtttgtcaagccctgtagcaggaacagcaggagtaactccaccagtcgttggcaggccaaccataactttgaaagcatcatagattccccactgcgcaccagttagagtaccgatcatgactatacgaaggggcagtccacgtgtgaaaagaccccacaacccaagtttcttcacggcatcaccaacagtggcacccttgggcattgttcaggaaagagacaagattgtcagctgggtgagaaacaattgcacagaagacaccagcaatgtaaccaccagcaaagcttcactcccagctgaagttctttgctacactggtcctttggtcttgggaatcgagtatttgtagatcatttcaacaatag

SEQ ID NO: 947 - DNA, 564 bp, Musa acuminata
  misc_feature (3)..(3): n = any nucleotide
  misc_feature (18)..(18): n = any nucleotide
ccnaaactcttgttatcnaaactagttttcaagcaacacaacagggtatctcaaacaatttgtctactaagaaattgacaaatcacaatgtgctaattaaagaaaactgaactttgaaccgcatgatgatgtagacttcccaggcaacaaatgacaattagctcactcgtcctcctgactacgcaaccttgctaacttgttggtgacaacaatgtcaagctgtgcggcacgctcaacaatatgcttgcgcttctttgtcgagatgttgtgagcaatttcagcacaataagtcctgttgtgcatcatgagcaactccaactcagcaacattgtgaaccacaaatttcttaaatccatttggcaggtagtggcgtgtcttcttgtcggaaccatacccaatatttggcattaagatacatcctttaaactttcttcttacacggctatcaatacccttaggtctacgccaatttgtcttcacgcagatcttgcggtcgctctggggcctcttgaacttcttgacgcgttcttcacgatcctcttcgtgagcatggaacgccatttg

SEQ ID NO: 948 - DNA, 539 bp, Musa acuminata
agaaatatattgcaacaaatttgatacgacaccagcccacaaggaactaaaacattaacggttcacaagaaaattgaacataaagcagataatcaagttttcaacataatgtgttctaagcagtctcacatgagacaactgaaatagctaaaaccacataaacataaaccaagtctgtagcttgaaaccaaatctgtagccaaatagaaatacactacctggttcggcaagacatgccatggagtttcatcagcgcaatctccttgcctccctttcggattcaagaagggtaaggatatcgccttccctcaccgggcccttcacgttcctcatgatcagccggttttggtcgtccagaaacttaaccctaacctgggtaacctgacctcttgatccagtccggcccatcaccttcaccacaactgcaagcttagcttgagtatccatgcttctgccgataagagtgtttgaatccacacaccaaagacaaccgctcctttccggaaatcgactcgaagaaaaggggactccggtctcgc

SEQ ID NO: 949 - DNA, 1149 bp, Musa acuminata
  misc_feature (8)..(8): n = any nucleotide
  misc_feature (16)..(16): n = any nucleotide
  misc_feature (21)..(21): n = any nucleotide
  misc_feature (24)..(24): n = any nucleotide
  misc_feature (27)..(27): n = any nucleotide
  misc_feature (29)..(30): n = any nucleotide
  misc_feature (39)..(39): n = any nucleotide
  misc_feature (522)..(522): n = any nucleotide
  misc_feature (613)..(613): n = any nucleotide
  misc_feature (1107)..(1107): n = any nucleotide
  misc_feature (1128)..(1128): n = any nucleotide
  misc_feature (1133)..(1133): n = any nucleotide
  misc_feature (1141)..(1141): n = any nucleotide
  misc_feature (1143)..(1143): n = any nucleotide
tcgagtgncgtcttancatgnccnagngnnagagcaaantttttttttttaatactgataatatgtcattgactaggatagataggagagttgtaacacaggacagagataacacagatgatactgcgttatcccatcttacaacctatcagcctgcccgaattattagagtacatagccacacaccttcttctacttcctttttttttttgttcttttgctttttatgcattgcaaacttttatttagtggtagtgacacaagtgcttctcagttgccacacttgcagtcggtgcaggcgcaggcggcgccgcacttgcacttgccgtcatgctcggcagcttctgcggcaacgatcacctcgtcgacgtagctcttctcggtctcaacaatatcgataccgtagctgtttcccttcttcacgcactggctcttgtcaacgcagtcgcagttgccgcaggtcgacatggttagacgaggaaggaaggctccctcttatttcttggcttgaggccgtgagangcggagaaagagagacacaatggcgactctggccggaggaatctacgactcggcgtcccaaaacagctctaaggtcgaagagctcggcacnttcgccatcgacgagcataacaagaaagcgaatgcctactctggagttggtgggggtggtgaaggtgaaggagcaagtggtggcaggtcaaatgtactacctgaccctggaggcaaaggagtctaatggagagaagaagctatatgaagccaagatctgggtcaagccctggatggacttcaaggagctccaggagttcaaggagttgggtgactcccttgctgcttagccagcaggaaagcaggaaatcttcatggtgtgggcgaatattatgttgaagactagtgtatcatgttgatggttgtgaaagtctatcttcaaaataaatttctgtaatgcagcagtatatagctaatattgctagcttttggtgttctttctgatattacactgtactaaattatcgcgtctgtggtgaaacatcagtgcactgttgcgctaacgtattatcgcatatttgtaaaggtattacattaggtctcatgatcgaattnatgccgaaaatgtgctgtatntcaantaatattngnaatagg

SEQ ID NO: 950 - DNA, 649 bp, Musa acuminata
  misc_feature (6)..(6): n = any nucleotide
  misc_feature (22)..(22): n = any nucleotide
  misc_feature (446)..(471): n = any nucleotide
  misc_feature (594)..(594): n = any nucleotide
  misc_feature (640)..(640): n = any nucleotide
acaganatttagtagaatttcnagtcctccaacggagaagaaatcgtatttcatacactaaccaaagaaatcaaaaggaaaccctaaatcaacacatcatagtaaaaggaagcaagatctgagagcagtcatgaccaccaccagaaaccctagaggcggcgagcgctcaggaactggtgaacttggtcacggccttggtgccctcagacacggcgtgcttggcgagctcgccggggaggacgaggcggaccgaggtctggatctcgcgggaggtgatggtgggcttcttgttgtagcgggcgaggcgggcggcctcctgggccagcttctcgaagatgtcgttgatgaaggagttcatgatggacatggccttgctggaaatgccgatgtccgggtgcacctgcttcagcaccttgaagatgtagatcttgtacgtctcgctcccnnnnnnnnnnnnnnnnnnnnnnnnnncgatgggcggcgccgtccttggaaagaggtgcttcccggccttggggctgcttctccgccctcttctccttctcttccgccgcagcaggcttcttctccgccggcttcttctccgccctgggngccattagggaacagagcttgtcgttgcaacgagaaaagatcgacnggaacgctg

SEQ ID NO: 951 - DNA, 529 bp, Musa acuminata
  misc_feature (11)..(11): n = any nucleotide
  misc_feature (490)..(490): n = any nucleotide
agccttgtgtntttagaagctgacaaacgagaaattactcggattacatgatgtaagtaatcctgacctatgaaattaatgtgttgtttttggctggttagtgccagcttatgttatcggactcttcactctgttcaaatttcatgaaacaggtggccgaaaaaatgcaatgatgctcagatggcagattttatcgagagcgaattccttgaagaacaggtggaagccatcaaaaagatatctgaatatgttgctcaattgagaagagtggggaagggacatggggtttggcactttgatcggatgctgctcgatgaaggaaagttgcatcaggcataggaatcatgtggctttgtcttggtgtgcaggatgtcttagatgaggtctctttacatgaagctttggtttggcatttccattggtgttttgaattagagacgtgtgtgacatggtcccctgctaaatttgttttatgtaagtctagaccgtntaataaaataaatattgtcgaaaaaaaaaaaaaaacgga

SEQ ID NO: 952 - DNA, 615 bp, Musa acuminata
tgtgactattaccctactcatgtcaaacggaatcaagttctggaactcacgaagcataatcccgtaatctcaatcacagtaacaacatcaagctaacaaggaatcttcaaccaatataaatttaacatgcaaatctcaaaagtgggaaagcagtactgtgagaaacatacattcagaaatatcctcagctaaataaaggcgagattaaactgttcatcttgaagaaactaccgaactgtttgtgaaaacaaaaatggggatatgctgacgaactacagtctccttcctcttcttccaccctttctgcgggtgctgtctgtggggatcggcgttacatcctcaatacggccaattttcattccagagcgagcaagtgctctgagagcagattgagcaccaggaccaggagttttcgtcttattcccaccagtagctcgcagcttaatatgcaaggcagtaataccaagttccttgcatctctgtgcaacatcttgtgctgcaagatggctgcatatggagatgattcatccctgtcagctttaaccttcataccacctgtaatacgacaagtgtttcctccagacagtctgtactgatgaagtgtcttgatgtgca

SEQ ID NO: 953 - DNA, 706 bp, Musa acuminata
aaaagttcaagctcaaacaagataaccgaaagcatcaaataacagtagtgacggtgcaaagataaaacagtcaacaaagcaagaagaaaataattgtcgacggatctcacaactacagataaccaaatagctatgtccgacgaggcgggacgtgcagaaaattacataacactacttatctgccatagaaaggtccagatttttttacatgaaagtcatttatcctcacttggccatcatgactttgacaaactcgtcatagttgatctgaccatcaccatcaacatcagcttcacgaatcatctcatcaacctcctcatcagtcagcttctctccgagattggtcatgacatgacgaagctcagctgctgagatgaacccattctgatccttgtcaaacactcggaaagcctccctaagttcctcctctgagtcggtgtccttcatcttgcgtgccatcagatttaagaactctggaaaatcaatagttccattgccatctgcatcaacctcattgatcatgtcctgtagctctgcctctgtaggattctgtcccagtgatcgcatcacagttccgagctccttggtcgtgatgcaaccgtctccatccttgtcgaagaggctgaaggctccttgaactccgcgatctggtcgtccgtcaactgctccgccatcgttgatccttttgtcccctctagagtagatc

SEQ ID NO: 954 - DNA, 595 bp, Musa acuminata
atcacagtaaattaacatagagctaccgctgtagcttcgatcctaaataaattagaatgaacctcaaatgcaacatagattcaaagcctacaatggcagaataaactgttcttttcgcagcatttgggtgaactacagtctcctccctcttcttccaccctttctgcgggtgctgtctgttggaatcggcgtcacatcctcaatacggccaattttcatcccagaacgagcaagcgctcggagagcagattgagctccaggaccgggtgttttcgtcttattcccaccagttgctcgcaacttaatgtgtaaagcagtaatcccaagttccttgcatctttgtgccacatcttgagctgcaagcatggctgcataaggtgatgattcatccctgtcggctttgaccttcatgccacctgtaatgcgaaccagcgtttccctgccagataaatctgtaacatgaatgaaagtgtcattgaacgatgcaaagatgtgagcaacaccaaacacttgctccccttctcgtacagccggcccaagtgtcacgttatctccttgggtccctggtcttctttcttccagaatggtgggcgcg

SEQ ID NO: 955 - DNA, 600 bp, Musa acuminata
  misc_feature (4)..(4): n = any nucleotide
  misc_feature (7)..(7): n = any nucleotide
catntgntttcatcatcttccaagttcaggatagttggattcaaacaaaacccatccatggggtttgtaaattaaaacagacagggatgatcatgagattttatttcgaggactcattttgccatcatgaccttgacaaactcgtcgtagttgatctgaccatctccatcgacatcagcttcacggatcatctcgtcgacttcctcgtccgtcagtttctcacctaggttggtcatgacatgacgcaactcagcagcagatatgaaaccattctgatccttgtcgaagactcggaaggcctccttcagttcttcctctgagtcggtgtccttcatctttcgggccatcagattgagaaactcaggaaagtcgatcgtcccattaccatctgcatcaacctcgtttatcatgtcctgtaactctgcttctgtagggttctgacccagagagcgcatcacagtcccaagctccttagtagtgatacaaccatcgccgtccttgtcgaacaagctgaaggcctccttgaactcggagatctgctcgtcggtgagctgctcgccatgcgccccctcaagaatcgggatcggcacaggggatcga

SEQ ID NO: 956 - DNA, 434 bp, Musa acuminata
tgtcattatgattagtatacgacgagcatcgacgaaaatagaaaaggctgcacgacatgtatagcacttgtaattgtaatttacacgagctatattgcatcaagaaaagaaccaatgagataggcattgtgcttatttagatgctaagagttcaaagtagcggtctgccaacgatggcctcggcaaccaccgccacatcaacagcctccgccgccacatcctccgcctccgcctccgccaccgtagtacccggtgttgttcttgcgattaggcgtcggctcattgctgtcgccgcagttgaagatgacgactgccatgatggatatcgtcgctgccaccaagcccagcataaacagaatccccgtcatgtgtgacgtcgaatcagctccatacgagcgatctccaagcacgaagatcagcaacctggccatccc

SEQ ID NO: 957 - DNA, 629 bp, Musa acuminata
ccatcttaatcagattaaccaggaatgatcacagaacgagatgaaatcattcagcaaaagaccatcatcatccccttcacccaagtaaccatatgacctgttgctaggtttaaggtttgacatcttgacaacatagataataggcgtcctcgatacaaggactatgtgaaactaagcactggcagcggcttttggatcgctggtagtataatctacgatcaagttcttagacgcgggcatcccagcaacaacatcctcttcgattccgcattcgtttgtgccccttgagatcttgaagtaaccatcatcaccccagcctcggttccactggtttgcaagaagccagtagtcttcaccctcatcgctagtcccccatccgatcagctttacggcgtggccaccgatttcatcgcctgtcaaatgcttgtagactcctgatttatagtgagcaaagtcctcataaacagtaaagctgacttccacaggaccatttgtgtagacctctgtcatgatagccggtggatccgattttactctataagcattgacagcaaaatgcttagactcatcccacaagagattcttaacttgacacttttttgcacattgtggggttggatatagaggta

SEQ ID NO: 958 - DNA, 766 bp, Musa acuminata
  misc_feature (13)..(13): n = any nucleotide
  misc_feature (19)..(19): n = any nucleotide
agaatatgatgantatggngacaatcagtacatattggtcttcatatagatgcaagtgagacctgagaattctggaataaagagacaaatcaacagaaacaagataagacatagtctaacaaggcacaaccaccacaagagataggagaatatataagagaaggttttcctactagtgtgcaatgattttttcccaacatttatcttatcttgtgggattcactttgccatcatgactttaacaaattcgtcatagttgatctgaccatcaccatcaacatcagcctctcgaatcatctcatcaacctcctcatcagtcagcttctcaccaaggttagtcatgacatgacggagttctgcagcggagatgaaaccattctgatccttgtcaaatactcggaaggcctctttcagctcctcctctgagtcagtatccttcatcttgcgagccattaagttgaggaattccgggaagtcaattgtaccattgccgtctgcatcaacctcattgatcatgtcctgtagctcagcttcggtaggattctggcccagagaacgcatcacagttcccagctccttagttgtaatgcaaccatcgccatctttgtcgaacaagctgaaggcctccttgaactcggagatctgctcgtcggtgagctgctccgccatggtcctccaaccagcaacgatcgacctcaacagagatcgagatggagagatctcttggtgggacgaagaagcgatcgatatcaagatggagagagaa

SEQ ID NO: 959 - DNA, 573 bp, Musa acuminata
  misc_feature (41)..(41): n = any nucleotide
cgaaaagtctctttttttttatttcactcaacaagagaatnaatctagtcaatcaatcacgcagtcgacaaccacactcccgaaataatgatatactccccgcaaaaagcccaaacgaattcgataacactaacaataagaacaagcctttgtcttcacaaaacgtagaatagcttaaagagaatgcataagatccggccgacctgcaagtcctcgggacggtactcatgcttcatggagagattcatggcgctcttgaggcgctggttcctggcgtccaccacctcgcgcgggagccgcgccaggacctccttgatgtccagatcgtacatcggatcgtacagatcgtcgtacatcagccctcgtatttcttgaggcgattgcagagggctttgtagtgctgggcggcgaaccggttgcgacgggggttgatgagccacttcatcaacgacgacgccatccccggatcggtcgatctatcgatcgaccaccgagaccttcctttgctggctcagctgaatcctctctcttcctcctccgcgcacacggcgataacaggcgaagaagctgctg

SEQ ID NO: 960 - DNA, 585 bp, Musa acuminata
  misc_feature (8)..(8): n = any nucleotide
  misc_feature (12)..(12): n = any nucleotide
ctagattnagcnttcaaccacaaaaaaagttgatataaataacagactaatagactaaattaagcattcaaccacaaaaaagttgatacatactctgcatgacaaacaagtctcatcataaaacctggcaaaaacaactagtttggatagatgaagtctttaatcaaaccaaggatcaagcatagagccaagattaaccaatggagactagtagccacccttgagatcattgaccacatcataaggaataggtgtaacggtctcaagtgtagcgccttccaccatgaaaccaggctttgggcccaccggctgccgtttggtgctgatgacctcaccccgtgcctttgcctcggccttcaactggtcattctttttcaccctcgcacggaaatcttcctggcaccttgaaggtagcacatgctccacacggacatggatccttttcttgatgatgcggttaccaacctgcttgttgatctcgacgccgatggcgcgcttggtgacgttccagaccttgccggtgcggccgtggtagaacttgtggggatacccttgtggacggccccgttcaccttgacatcgaca

SEQ ID NO: 961 - DNA, 743 bp, Musa acuminata
  misc_feature (288)..(288): n = any nucleotide
  misc_feature (489)..(489): n = any nucleotide
  misc_feature (517)..(517): n = any nucleotide
  misc_feature (529)..(529): n = any nucleotide
  misc_feature (532)..(532): n = any nucleotide
  misc_feature (534)..(535): n = any nucleotide
  misc_feature (541)..(541): n = any nucleotide
  misc_feature (543)..(543): n = any nucleotide
  misc_feature (563)..(563): n = any nucleotide
  misc_feature (575)..(575): n = any nucleotide
  misc_feature (616)..(616): n = any nucleotide
  misc_feature (649)..(649): n = any nucleotide
  misc_feature (664)..(664): n = any nucleotide
  misc_feature (680)..(680): n = any nucleotide
  misc_feature (687)..(687): n = any nucleotide
  misc_feature (693)..(693): n = any nucleotide
  misc_feature (695)..(695): n = any nucleotide
  misc_feature (697)..(699): n = any nucleotide
  misc_feature (705)..(706): n = any nucleotide
  misc_feature (713)..(714): n = any nucleotide
  misc_feature (726)..(728): n = any nucleotide
catccgaacaatgagcaaattgcagagtgatgttttgagggaagcaatctcccaggttgttggtgattctcgggagaagaaacgaaaattcactgaaacagttgagttgcaaattgggctgaaaaactatgatcctcaaaaggacaagcgattcagtggatccgtgaaactacctcacattccacgtccgaaaatgaaggtctgcatgctcggagatgctcaacatgttgaggaggcagagaaaattggccttgattatatggatgttgaaagtttgaaaaagatgancaaaaacaagaagctggttaaaaagcttgcaaagaaataccatgctttcctagcatcagaggccatcatcaaacagatccctcgtcttcttggccctggtcttaacaaggcagggaaatttcccacactggttactcaccaagaatctctagaggtaaagttaacgagacaaaagcaatggtgaaatttcaactcaagaanttctttgcatgggcgtggcagtgggttnactgtgcccatnggncnngaagcnanttctttcagaacgtttcacncagcgtaaattncctcgtgtctttgctgaagaagaattggcaaaatgtgagangcttgtacctgaagagcaccatggggaagccanaccgagtgttctaancggctgatcgatgaantggaaantctacngncnnntccaanntctagtnntttttgtttatnnngcagtattaaaggac

SEQ ID NO: 962 - DNA, 557 bp, Musa acuminata
ctttattctttaaccacgtaatgacttcaaaacaaatgttgaccgaagataacaacacacgggcggttacggagtctcgttgactcgatccattgccccctcacttcttgggcgcaaggcggctcttgatatcctccacctccttggtgccgatctggaaggccttggcgaggacgtcgtcgggcaccgtcggggttgccgcgaagagggtggcagcgatggactgggtgccggggagctggctgttgaagccggcgatgacggcggcgggcactgcgccgttgttcttctggaagtggacgagcccacgggggaagacgaagacttcgcccttggtgatggtcttggctatcagcttgttggcggtggtgatgaagcccacgtcgagggtgccgtctaggacgaagacgatctcggtggcgcgcgggtgggtgtggggcgggttcaacccgccgggggcgtagtcgatgcgggacatggacacgcccagggtgttcagcccgggtatcttctcgacgttggcgccggttacgagggagcccatggtgttgttggtg

SEQ ID NO: 963 - DNA, 553 bp, Musa acuminata
  misc_feature (539)..(539): n = any nucleotide
actttatttccaagagatgattaggtagcgtttggaatcagcaacatctgcctctcgtttcggtgattccgacaacaaaatctaacaaatgatggcagcgagaagggaggaataatgcgtatatacatggtagtacattgcgattgcgtagtccggtccttccacggtccatgtagcagagattggaagatcgaacggtggtggcgtttagaattgcagcagtgaattggccgtgtcatacttcatcttctccaagttgggcaccacggcgaaccggatcatcggcggcggcccgcaggcgagtgcgagcgtgtcgtcggagccgcccaacgggaggtgctctcttaagatgctctccgtgatgaagcccgtgctgtacctccactcctcgccccgctttgcctcgtcgatcacgtaccacaccttgaactgctccgggcgatcccgcgcccagccgtcgagctcgtcccacagcagtatgtcgtcctccgaccggttggcgtacaccaggtgatctcggtgcggtcctcgggtcccgnagaccgcctggata

SEQ ID NO: 964 - DNA, 567 bp, Musa acuminata
taaagtacattaaagatcacgatcaactaatacaagggataaataaatagtctgccaccgaggccggcgatgagaactcaaacaatctacgtaatcgcttctctcccaaaccaacacagccttaccgaagcaaaggaagggttcatatctctgaaggaacgcgtcggtacaggtgggacggcaacctcggcgtggccacagcccgcaagggagtctgcatgaaggtgaccatcccccggagtctccgtcatgtcgacgtcctccggcttgacacccgtccggcagagtccagctgaagtggtgcagcaggtggccgagcatggaggtgaccaggttgatgcccagctgcgccccggggcagacccggcggccggtgccgaacggcagcacccggaagtcgtgtcccttgatgtcgatgtcctcttccaggaaccgctcgggccggtactcgagcgggtttttccacgtcttggggtcacgggcgatggcccagacgttgacgatcacgttggagcccttgggaatgtcgtagccgccgatcttgaacgttggcgttgggcttgtgtg

SEQ ID NO: 965 - DNA, 555 bp, Musa acuminata
  misc_feature (10)..(10): n = any nucleotide
  misc_feature (29)..(29): n = any nucleotide
atagcatgcnactaataattactagagtnacacgagataaaagtaagttaaacatttgattaagacgacaaggcatgcggcttccaatgcatcataatgcgtaaagaagatttggcagaaggtttatctgatcacataaaagaaaaaactaaaagagaacagacacaaaccaggcttgattccagcaggggggatcatcatttcttcttttcactcactccagcagacctcatcttccggagaacattagccatctcctctctcttctttttggctctcttgtgtgtacccagctttctcttagcaactttcagtgcacgcttgtcctttccaactttcaacagctccgtaatcctcttctcataaggtgcaaacccagccacttccctgatcaagttcctaacaaaatgcaccctcttgctagttttcccttttctgctggaaggacgagggggcaactccctcctggtgacgatgtgccccttgttgagcccaacaaagagaccggtgttcggctgaggaggggcatctcaaagcccggcgagaaaacaccgt

SEQ ID NO: 966 - DNA, 576 bp, Musa acuminata
  misc_feature (4)..(4): n = any nucleotide
  misc_feature (6)..(6): n = any nucleotide
  misc_feature (8)..(8): n = any nucleotide
  misc_feature (26)..(26): n = any nucleotide
accnananatctgatattattctganttaaatatttattgtaaggttgttacttttgacaaattcctgaaaaatcaaacaccacataaacccaatcacctaaaagattctgcgggtcaaaattacttgctgaattatcaaaagtttaaagccttcattgaaattaatcctccaacgactgcaggggataacattatttcttcttatcactcactccagcagacctcatcttccgaagaacattagccatctcctctctcttctttttggctctcttgtgggtgcccagctttcttttcgcaactttcagtgcacgcttatcctttccaactttcaggagctcagtaatcctcttctcataaggagcaaaaccagctacttccctgatcaagttccttacgaaatgaaccctcttgctagttttcccttttctgctgcaaggacgaggaggcaactccctcttggtaataatgtgccctttgttgagcccgacaaagagaccggtgttcgggctgagaaggggtcatcactaggcccggatgaagcacaccgtccgttccccctactccgacagcaa

SEQ ID NO: 967 - DNA, 597 bp, Musa acuminata
aatttaggttccaaaataatttgattcatccgatacaagggcatgtaatctacaggtcagcactgcatcaaagtgacacaggacaagccccgtgaaagaggtttcatgatcccagggcttcgccagggtggccagaccgagtgttcagcaggggttgtagcgccttgactacgatactcatgttcgggcggaaatcggcttcatattgcacacacaaggcagccaccgcagcaaactttgcaactgctttgggaggaaaatctccgcctagtcttgagtcaatacattgccttaccttgtcttcactgagtctgggtgttgcccaagtcacaagactttgttgtcctcttggtaatgtatgatccacaggtttgcggccagtcaagagctccaataagacaacaccaaagctgtatacatcactcttggagctaagttgaccggtcatcgcatactctggtgcatgataaccaaatgtccccagaactctagtagaatgaagacgagcagccatgtcaggagcttgatttgataggtcaaagtctgctatctttgcaacatcatcatcaaagagtagaacattgctgggtttatgtc

SEQ ID NO: 968 - DNA, 429 bp, Musa acuminata
ttaatttaacatggaatgaaatagagacatgctgatacagaaacagtgcgatctatagagcaatctatagtggtgtggcggtgaccggatgctacgttatgtgggttgaactcatctgcttgcatgcttccttcgtccaatccaaatccgtcgtcgtcatcgctatctacatcctgattcttccgaggaggcagccattagctgggagctgcgaacccgccacccttcatcatctgcttgaactccttaaagttgacgacgccgtcaccgtccacgtccacctcgttgatcatcttccggcagtcctcggcggtgcggccttgcttgaggccgagggaggcgagcacggagcgcagtcttccacggtgatgaacccgtcgccgttgcggtcgaacacgttgaaggcctcgcgcatgtcctcctcctcgt

SEQ ID NO: 969 - DNA, 533 bp, Musa acuminata
  misc_feature (4)..(4): n = any nucleotide
  misc_feature (6)..(7): n = any nucleotide
  misc_feature (21)..(21): n = any nucleotide
acanannacgcaatctttatnttattgggacgcatcgtcacatcaatctggaacacctttctatcactgtcccgccttattcaagacctcgtaatcggaagcacacatatggtagtgagtacatcgccatctcaaacactgttcctcacggcagcgccgtacccgctgttgagatcgtagtatctgctccacagcatgatgccgccgtatttggacgcagtcttgatcgccggcagcacctgggaggtgaggacgtcgggcgggatgtacccgctcccggccgcgtcttgcgaggccggcagccccaggaagacggtcgatgacgacaagctcgacgtccacgtcccccatgcgctgctcaggccgctgacccccgacgagtagtcgcagccgcggttgttgtagaactgcacccacacgtagtcgaagagccccgtctgcagcgcgttccccaaggactggtccgggtaggggcactgcggcgccgccgagaggtacaccttggtcccagcctggccgcccaagttcggaga

SEQ ID NO: 970 - DNA, 532 bp, Musa acuminata
agaattgtatagttcttacaagtttctagcataaaagttcttctatatacccgagtagcaatagaaaccatgaagactcattcaggcatgatccataaaagtcatatttcctgcgcacaacgccactatctcaagcattagttaccttcgtactttgggtctgccatcacataatgataagcaattaccaaaatgaagataaatatgccaagaaaattagcaaagaatcccaagtcttgatcgtcgatcatcttcgccttcgcttcctccctctgcgaaccacagatctcgctgttcgcgcttcttctcgcctcgccaaggaagtggaggcggcgagggccgtggtcgagggcggcaacgcggccatcgccaacaggatcagggagtgcaggtcgtacccgttgtatcggctcgtcagggaggagctcggggttgcatacctcaccggcgagaaggcgcgatcccccggagaggagttcgacaaggtgttcgtggtgtcaacgaagggttgctgatcgatccgtctcgaatg

SEQ ID NO: 971 - DNA, 865 bp, Musa acuminata
  misc_feature (401)..(401): n = any nucleotide
  misc_feature (855)..(855): n = any nucleotide
atcttctcacatcagcgaattccacgatcttcttctttgtcatgcaaagacagacagcagaggcagtcattcctcgttgtcattttattggatggtaagatagcattacagcatcacgaactgagcatgcaagcaagcttatttatatagatcgatgtatttatatatgcttgcacgagatggtgtggaagagaggcaacagatcagtcgccgcagttgacgaactggtagttgacaatcaagtggcctcgattgtagccgccaccatcggtatccagttgagagaagacgccttggtctaaatctaaccctccgttggcgcactggtccacgatcctgaccgtagcctgagttcccgtcgccgtgttcgtcacccgcaagcacttgccacccacgcgtcngggatgagttacgggatgctgtcttgcttgtgtttgcgaacaaacaagaccttccaaatgcaatgaatgctgctgaaatcactgataagcttggtctgcattccttgcgtcagcgacactggtacatacagagcacttgtgctacatctggtgagggcttgtacgagggacttgattggctctccagcaacatagccagcaagtgaccaaagttgctcaacggccctcaacagcagacaaaatttggcatttcagtgttggatgctttggtgaatcgttaccaagacaacaaaatttgaaggttccactggttaccaaaactttaaagatatcggctgcctcagaccttttatgctttttatctatctactcctttttctggatatatctaggatgatgatactcttgtcatatatttctcacaccactgggtgcccattatgtcatctgatanttcttactta

SEQ ID NO: 972 - DNA, 506 bp, Triticum aestivum
  misc_feature (15)..(15): n = any nucleotide
  misc_feature (494)..(494): n = any nucleotide
gcctcgatcgaacangaacctttccaaagattctccttgatcggcatctaaacaacaaaccagcggcacccaatgaagcaaaagattgtgatcaaggtgagcatgtcatgcgacaagagccggtcgaaagccatgacgatggtcgccaaagcgaacggggtgagctcggtggggataaccggcgacagcaaggacatgctggaggtggtcggcaacggcgtcgacccggtgtgcctcgtcggctgcctccgcaagaagtaccacgacgttcacctcgtcaaggtggaggaggtgaaggacgacaagaagaaggatgagaagaaggaggacccgccgccgtactggtaccaccacccatatgggccatacccgcctcacatggtcgtgtgcgacgagcccaccaccccctgcgccatcatgtaattgccaaatagccagatgcccagttcgccatttggagaggccgcaagtttatccaccatttcgggctattngcaaattggagg

SEQ ID NO: 973 - DNA, 445 bp, Triticum aestivum
gtggtcctggcgctgaagctggggttgatgtgctcgcaccccatgcccggcgcgaggcctagcatgcggcaggtgatgcagtacctcgagggtgacatgccgatccccgagctgacgcccacgcagatgagcttcagtatgctggccctgatgcagagccaagggttcgactctttcgtcttgtcggcgacgtcggatccgtcgtccgccacgaatacgatgatgaccatgggcacaatcagtggactctccggagggagatgacatagttttcaatttcaaggactcgagagttgtgctgtgcagatgttgatcaggtgtcacgactagtattggtagagctataataaccctgttctgtgtgtagtcctactactttggtatagtttccctgagatcctcgtatcatacatgtactgtataagcccagaaaataagttgatat

SEQ ID NO: 974 - DNA, 495 bp, Triticum aestivum
  misc_feature (492)..(492): n = any nucleotide
cgagattatgaaatcttcgaccgtggaatgtatgctggacctgttggttggtttggtgcagctgaaagtgagtttgctgttgggattagatcagcactacttggaaaaggatatagcactttagtttatgccggtgccgggattgtcgaaggtacaaatccatcttttgaatgggatgagcttgatctcaaagcatctcagtttgcaaagttgttgcagtatcaagaacatgatatttgctaccaagaggcaggaaacatggggacattgatttgaactgtaactagtaagtcatcagagattacagcacttagtaagaggcgggaaattgcgttgtctcaattatatagaatgtctacaacttcagtttgtatctgacattatgcccgatgtgtttattttgaactccttctacagggaagttttgatttgttgggaagattccaaatggagttcatatctgtttatgtgcgtgcgttgtcggcgggagancga

SEQ ID NO: 975 - DNA, 605 bp, Triticum aestivum
accatgatgaccattttcatgctagcaatcgaccataccgtacgactacttggtgaagccagggcatcacaccggctttgtcgtgctctacgggctcactttcttcttcgccaacttcggccccaacagcacaaccttcatcgtgccagctgagatcttccctgcgaggctccgatccacatgccacggtatctctgctgttaccggtaaggcaggcgcgatcatcggtgcattcgggttcctgtatgcgtcacaggaccagaagaagcctgagaccggctactcacggggaatcggcatgcgcaacgctctcttcgtgctcgcgggcacaaacttcctgggtctgctcttttcgctgctggtgccggagtccaagggcaagtcgctggaggagctctccaaggagaacgttggcgacgatgactccattgccccaactggtgtctagagacgtgcaggtgtacttgcacactcgtgcattatttgtgtgtttgatttgagtttctgtgttctgctgtttgttttgttcatgcaattttctgaacttttagtgttgtaatggcgtgacaatgtaatgcgtaaactgtaaagacaatgagtaaatt

SEQ ID NO: 976 - DNA, 689 bp, Triticum aestivum
ccagagctcggcgtggcgcatgaacaggcgctgacgggcgagcagatggtggcgttccaggaggccttctcccctcttcgacaagaacggcgatggatgcatcagcttggaagagctgccgcggtgactcgctccctcggcctcgatccgaccaaccaagagctcaatgacatgatgcgtgaattcgacatggatggaaatggcaccattgatttccaggagttcttgagcctcattgccaggaagatgcaggatggagatggagatgaagagctcaaggaagctttcgaggtcctggacaaggatcggaatggttttatctcccctgttgagctgaggacggtgatgatcaatctcggggagaagatgaccgacgaggaggttgaggagatgatcagggaggcggacactgatggcgacgggcaggtgaactacgacgaattcgtgctcatgatgaagaatgccgagcgcaagataactgggtgaacaaaattaaatatgctgtttgctctaaaaatatatatgctggcgatagatgtgaaaccactggttctcagattggatgcactgtctccgttgtaaattcgctgcttgtggtactgttattttctgaagccactgtaagcttgtgtattcatcttagaagctgtttgtgcactatataaacggcaattgccacatatatttac

SEQ ID NO: 977 - DNA, 664 bp, Triticum aestivum
tccgggctgcaggtccggcgcgacggccgttgggtggccgtaagcccggtgcccggggcgctggtcatcaacatcggcgatcaactgcaggctctgagcaacgatcgatacaagagcgtgctccaccgggtgatcgtgaacagcgagagcgagaggatctcggtgccgacgttctactgcccgtccccggacgcggtggtcgcgccggcggaggcgctggtggacggcggccaccctctggcctatcggcccttcacctaccaggagtactacgaggagttctggaacatgggcctcgagtccgccagctgcctcgaccgcttccgaccgatcgcatgatggactgtccgtccggctggctgtgggcaacaaaatctcacgggccacaaatgttgcttgctaccgatgatgtgtcgccataggggaagacctctgaaagacgcccggagccgtcagatatagttttggatggctataagatcggggtgaacgggagaactttgtccgtacgaacttcagttctccctgaccttagcactagagatacgaccggtgctttcataaaagaagaagatgcgaccggtatttgacgcaaggataacttgtgggcgtccatcgagctgtctatcttctaagtgcttgaaacttaactagtttgtgaaat

SEQ ID NO: 978 - DNA, 782 bp, Triticum aestivum
tcacatatcgtcactatgccctctattgaggtgggcacagttggtggtgggactcagttggcgtcacagtctgcatgcctggacctgctgggcgtgaaaggcgccaacagggaatcgccaggatcgaacgcgaggctcctggccaccgtggtggcaggcggggttctcgccggggagctgtccctcttgtccgccctcgccgccggccagctcgtcaagagccacatgaagtacaacagatccagcagagacatgtccaaggccgcatctctaagttcttgattgattgactcgacgagctgcagcccaagaaaccaatggagaaatctagagtgtggcttgattctacacacaggaagtgctcatcaacatcaagctgagaagagtttgaccagtttctttctcgatgctggccggtgtttctgtcgtcgttcttcgcgtgctgccgctgctggcatcgtcgacggacggccccgggcggcaccggagaagctaacctttttagcctgtttgtgttcataaggctttgtggttggttgggttggttaccttggcgcgcaaagtgtggggatctttttgtagcatcgaagtgtagagatctctctccttgcttcaggaagccagccttgtagtggtatctgtttcaccttttgtttgcttctttttcctttatgctagtcgaacaaatattacgaaaagatatggtaacgtgattgtagaaaaaatgtgggtctcggcggagattcatacacaagaagcaataggaaggcggcatccagtcc

SEQ ID NO: 979 - DNA, 569 bp, Triticum aestivum
cccgccgaacagcaaccagacgttcccgacgacgacgacgctcatggacctcgtcacgccggcgaggttcgacaacaagtactacgtggggctgaccaacaacctgggcctcttccagtcggacgcggcgctgctgacaaacgccaccatgaagtcgctggtcgactccttcgtgcgcagcgaggcggcgttccggaccaggttcgccaggtccatgctcaagatggggcagatcgaggtgctctccggggcacagggcgagatcaggcgcaactgcagggtcatcaaccctaccaacgccactagtaccggcgccgttcaccatcatcttctccccagatcatcaggttcttcaggatccaaccaggtggctgcaagctgattagttggtggtcagtcgagacatgtgtacgtgcagtgtgcatgaggtcgagtgctccggtcagtgtgaaataataaattatctgatgttttgtctgatcgtctgtgctacgatttgcgagcgtttgaaatgaacagttccaaaatgttcctattacaattaagcatattccgtttctcaagttaaa

SEQ ID NO: 980 - DNA, 603 bp, Triticum aestivum
gctcctcatcctctcaatcttcggctgcacccccggcatggcctggacgctcgtcaacctcggccacttcgcgattacataccacttcttccactggaagaagggaactccatttgctgatgatcaggggatgtataatcgattgacctggtgggagcaaatggacaacggcaagcagcttactcgcaacagaaaatttcttgttgtggttcctgtagtcctgtacttgatcgcttcgcacaccacagactatcaacatcctatgctctttttgaacaccattgcagtcacagtactggttgttgcgaaactaccgaacatgcacaaggtccggatttttggaatcaatgccggtaactaagcggcagcgtcccagggtagacagcactcaatatcatgtttcatttgaatggctggatggtgttgcacctagttctgaattcgctcgtcagagtaccagtgtgtagtgtttgagagctgttagtagatgacatgtgatcattgtacagagaaacgctaaaaggcctggaaaatgatgctgttttgcaactttgcccgacacgttctgtagactctttatgctgctatatgttttgttgcaag

SEQ ID NO: 981 - DNA, 883 bp, Triticum aestivum
cccgatcgaagggatggccggcaccgttgaggacagcgggaacacggcgccgtcgtcgccggccgggctccgcggcgccgacctggccctgagggtgcttctgttcgccgtctcgttgtcggggctcgtcgtgctggtcaccgccaagcagacggagatggtgcccctggtcctgacgccgccgttcagattcgggccggtgcccgcccagttcaaagactcgccagcgctcatttatcttcttgtggcgctgtgcatgacgagcttgtatagccttctgacggccgccacctcggtcaagtccatgtcaagttcggcttcctgtgccaaggggatcttcgtcctcattctgcttgatgtggtttacgcgggcatcatggcgtcggcgacgggcacggcgggggccgtggcctgggtggggctgaagggcaactcgcacacgcggtggaacaagatctgcaacatctacggcaagttctgccggcacatcggcagcgccacctgcctcggcctcatcgcctccatcatcctcgtcctcctcgtcgtcctcaacgcctactccctctaccggagaagccgctgatcgaactaggcgtccagccccgctccctcctccggctggcgggacaaatttcatgtgccgtgcatgtcatccgtcggctttggtgagctctgccggccggcggtcagttgtataaaagatgctacgtgttcctgtggctgtggagtgctctacgacatgcgtgtgtgcgtgcgtgtacatgtgcgttgacgtttatccttgtttgtttctacaacacgttgctttgtgacagtaagcacgacttttatcggccaaaatcactgttgtaacctttgtggcatagtttaacatgatttaatt

SEQ ID NO: 982 - DNA, 845 bp, Triticum aestivum
gactacgttcgcggccatctcgagggaagtgtggccggatcttctccgactggctggcgagcgcgggacgcgggggctgatgatcctggacccgtacggcgggagcatcgcggtcgtggcggaggcgtgcgacgccgttctcgcaccgcgcgggcgtgctgtacaacgtgcagtacatgaacttctggggcgtgggcggcgacggcgcggcgcacacgacgtggatcagggacatgtacgcgttcatggagccgcacgtgagcaagaacccgagggaggcgtacgtgaactacagggacctggacatcgggcagaacgtggtcggcgccggcgacgtctcgagcttcgaggccggcagggtctggggggagaagtactactccaaggccaacttccggaggctcgccatggccaaggggcagatcgatccccgcgactacttcaggagcgagcagagcatcccgccgcttgttggctcgcagctggagctgacctccgccaggaacgcgccgcacgttgatggcgtgaatcctccgggttggtgggcagtggggtgtgggacaggcagtccgtgttcagtccttagctctgtcttggctaaactgatgcctagtttcttttagacatagctcattctgttttaccacgtagtacttgttggtcttattgtcaatggtgtttgctagcggaaataaagtctgaaattatggttagtgtttgaaacagaatgagctatgtctaaaagaaactaggcatcagtttagccaagacagagctaaggactgaacacggactgcctgtcccacacacactgcccaccaacccggaggattcacgccatcaac

SEQ ID NO: 983 - DNA, 929 bp, Triticum aestivum
  misc_feature (876)..(876): n = any nucleotide
cagactcagcgacagagagcagccagtagcctcctccgccgccacccatgtcaggaggagggatcgcgcggggccgcctcgcggaggagcgcaaggcctggcgcaagaaccacccccatggattcgtcgcgaagccggagacggtggccgacgggtcggtgaatctcatgatctggaactgcaccatccccggaaagcaggggactgattgggaaagtggatactacccacttactctccacttcagtgaggactaccctagcaaacctcccaagtgcaagttcccgcagggttttttccacccaaatgtctatccttcagggacggtctgcctctcgattcttaatgaggatagtggttggagacctgccatcactgttaagcagattctagttggaatacaggatttgcttgatcaacctaatccagctgatcctgcccagactgatggttatcacctctttatccaggatccagcagagtacaagagacgcattcggctgcaggccaagcagtaccctgctctggtttgaggatccaacgtagcagtctaaaatcataaattaccgcacctgaaaatatgaagtatgactaaatataaccgaaagcggggtattgtggagagctttccattgtgaccgtggacatttgtgacgtgtggtctggtgttgaccaaacaaaaatcaggtccttctgcttgaatgatggatgtgtggatacttttgaacttaactccttgattgtgtcttctcgactttttttgtgtgattgtttcggtgatctcttcaaaaataatttgatgtgaacacttccttttaaaggaagatgtaaaagaaggggtaaggcaacccagttgaaccctaaatacagtaggantttcaaaaggggacgggttttcaataaagttaatgattctctgtaggcgatgg

SEQ ID NO: 984 - DNA, 475 bp, Triticum aestivum
  misc_feature (5)..(5): n = any nucleotide
  misc_feature (55)..(55): n = any nucleotide
  misc_feature (59)..(59): n = any nucleotide
  misc_feature (97)..(97): n = any nucleotide
  misc_feature (125)..(125): n = any nucleotide
  misc_feature (135)..(135): n = any nucleotide
  misc_feature (140)..(161): n = any nucleotide
  misc_feature (163)..(163): n = any nucleotide
  misc_feature (165)..(165): n = any nucleotide
  misc_feature (188)..(188): n = any nucleotide
  misc_feature (191)..(192): n = any nucleotide
  misc_feature (210)..(210): n = any nucleotide
  misc_feature (222)..(222): n = any nucleotide
  misc_feature (233)..(233): n = any nucleotide
  misc_feature (251)..(251): n = any nucleotide
  misc_feature (259)..(259): n = any nucleotide
  misc_feature (282)..(282): n = any nucleotide
  misc_feature (309)..(309): n = any nucleotide
  misc_feature (342)..(342): n = any nucleotide
  misc_feature (367)..(367): n = any nucleotide
  misc_feature (382)..(382): n = any nucleotide
  misc_feature (400)..(400): n = any nucleotide
  misc_feature (462)..(462): n = any nucleotide
catcngctactccgagtagccggcggcgccgcccgaccgcgtccccggagctgcngagnttcatcagctgctgcttccagaagaacccgccgaagcngccgtcgtcggcgcagctgctgcagcancggttgatcncctcnnnnnnnnnnnnnnnnnnnnnngncntcgccgccccgccgtgctgacgnctnncccgccgtaaccaagttnaattcggagggntcatggacggncggacggacggtggccgncggcgacncgtgggatctaggaggaggaggngcgatcttccttcttcttagccatttngggtagtgaagccaccaccacaaatttacccanccatccctctgttgttgctgtcgcncctgaaattaagctnaagcttttctttagtttntctgttaaatgttaattaaatgttgtctccttcaaatgatgatgctcgaggaggaagatgangtataatatgggt

SEQ ID NO: 985 - DNA, 752 bp, Triticum aestivum
tatatattgtggtatattgtggactgctctttcagtagtaatgccagaccctccggctgaatcaatgaaatgggtaaaaggggcagcaaaatttagaaagctggcaattcctgccagtgctgttgtaggcattactgccatatctggagcgttcgttgcagggaatgatgcagggcgtgcatacaatacatttccgaagatgggtgacagttggattccagaagatgtgttcagtatggagccttttatacgtaatttctttgaaaatacatctactgtgcagcttaatcaccgaattcttgctacaagcaccttattgtctgtgagtgccttatggctggctgcaaagaaagtagatatgcatccagcggtcaaatctctggttggaagcacacttgggatggctgctcttcaggttacattgggaatatccacacttctgatgtatgttcctacctctttaggctcagctcatcaagctggggcattgacactactgtcactgatgatccttctcactcacacattaagaagaccatcaccagctctcttgaagtcacttgcttctgctgtgaaatcaacctgataccacgccatgaattagtcaccatggctatgtgatatattttgcccttctaatgtgcactggcccccttgtttctttgagtgctaaagtattttggtaaaaaaaaaacattcttgggtagaggctgcttcatagtagttttctagcgccaaatattacaaaccct

SEQ ID NO: 986 - DNA, 342 bp, Triticum aestivum
gccacgccggacgcgttcgacaacagctactaccacaacctgctgcgcaaccgcggcctgctccggtccgaccaggtgatgctctccgcgccggacggcgccgcggcctccacggcgcccatcgtcgagcggttcgccgccagccaggccgacgtcttccggacttcgccacggcgatgatcaagatgggcaacatcgccccgctgaccggaagcatgggggaggtcaggaggaactgcagggtggtgaacagaagcggatcgcgccggtgctgtttgttgatcaaaggagtcattcatttgatttattgattatcttttgaaggaagtcaatttgagacga

SEQ ID NO: 987 - DNA, 690 bp, Triticum aestivum
tgtgtttgattctgttagtcaaataaatggaggaaacccatttacagatcaaatgctcactcgccttaaggtaatgttgaaatatatttgtgattctcatctctagcttgtatttttgtaattcttatgcttatctcatcttgtaggaggtgcatgatagagagaaggaggttcatgatgctctcggatattcagaggaccaaatatctgaattgaagaaggagatccacagaactcgggatgaacagcttgcaaacattactgccatggtggaggaaaagctgaatatcacggtggagaagctgcaagttcaactcatggaagaacagaatgcaaggctggaagcagagagggtggcggcggaggccaggctgaaatccgacgaggagatccgcaagctcaaggagaggctcgagaaggctcaggaggaaaacgaggagttccggaggctggcggcgaacaagtgcgccattctgtaaacagtagtctcttgggaaagagttgtcggatgtcttgttaataggagggggtgaacttaagtctgtctagtagcaacagatatactgtacttggttgcatcgtctcgtatattggtagaacttgaatgcttggggagtcggataactatatgttagtgacagttatacttgtcgtctcgtatattagtagcacttgcgacttgcgagtatc

SEQ ID NO: 988 - DNA, 352 bp, Triticum aestivum
aggcgctcggcggcggcgcgggagtggcgcgtgtggggcgagtgggcgatgggcgcggccaaggtggtggcgcactacggcttcatcccgctcgtcatcgccgtcggcgtcatcaagtccgaccccaagccctccctgttccagctcctcgccccgttctgatcgatccccgccaccgtccgcgtgatcgcgcttcgctagggttcgttcgagagatgaaacagtcagttgtgtccgtggtagttagttgtcatcatcagagaacttgctagaattatctgtgctgcacctgctattctgctctggatcaaattgaacctgaatcgctgttacgtagtactagtataaatta

SEQ ID NO: 989 - DNA, 843 bp, Triticum aestivum
ctcctcgccgggcgtgacacggtgcctccgcgcgaccacgctcttcctccaccgtccaagaaccctcaagtcgcggcagccattcgcgcggaagccggcggcgacaagccgtccacgtacgagcatctcaagagcctgcagtacacgcacgcggtgctgtacgagaacatgcgcctgttcccgcccgtgcagtttgactccaagttcagcgctgccgccgatgtgctcccggacggaacctacgtggaaggagactcgcgcgtgatgtaccacccgtacgccatgggccgcatgccgagcatctggggcgccgattacgaggcgttccgccccgaccggtggctcactggagccggtggttcgttcgcgccgcccagcctgtacaagtacccagtgttccaggccggcctccgcgtgtgcctcggcaaggagctcgccgtcacggagatgaaggcggtcagcgtggccgtggtgagagctttcgacgtggaggttgtcggagagaatggccgcagtggctgggcgccaagatttgtggcgggactcacggcgtccatcagcggtgggctcccagtgaggatcaagcgcgcttcgacgtcgagtgcagacttcaaataattactagtgaaaaactgggatgcgctaacaatgtacatatatagagagaaataagtaggagatatcagtaggatagttgtttctttaataagaaaatcaacactttcatccgttaatgttcaccgttatttccaaaatttcatgcttaattgtgctataatttcagaaaatcgaccgaaaaaggaaggttacaggtctcaggcatctaatgagaccaaaacactt

SEQ ID NO: 990 - DNA, 736 bp, Triticum aestivum
aacagagctcagaagcaagaaacagagaaagatttttacagattcctttgcaatttgcgtagcatccagttcacggcgagcaagatggtggccaaggaggcgatcccgctgctgacgccgcacaggatgggccggttcgagctctcccaccgggtggtgctcgcgccgctcacgcgctgccgctcctacgccaacgtcccgcagccgcacgccgcggcctactactcgcagcgggccaccaagggcggcctgctcatcgccgaggccaccggcgtctccgccaccgcgcaggggtacccggagacccccggcatctggacgcagcagcaggtcgacgcctggaagcccatcgtcgacgccgtccaccgcaagggcgctctcttcttctgccagatctggcacgtcggaagggtctccaccaacgatttccagccagatggacaggcgccgatctccagcactgacaagcagataacacctgatgctgagtccggcatggtctactccaagccccgacagcttcaaacggacgagataccgctgatggtcgatgacttcagacgtgctgcccggaatggcgtcgaggcggggttcgacggcgtggagatcccggggcaccgggtccctattgggcggtctggaagcagtctatggtgggcgggggtcggggcgctcgaaacgggcgcttgcggggggatgggctatccaggagggggccctcgccagtgccccgggc

SEQ ID NO: 991 - DNA, 585 bp, Triticum aestivum
cgtgtggactccattagcaggggcccacacaaatggcttctcgcatgccttgactgcacatgtctctacgtccgtgatgctcaccgactgagcgactcactggagacttatccggagtacctcaagaacgatgctaccgagtccggcgaggtcaccgatcttaaggacatgcaggtcggcgtcggtcggcgcttccgcgggctcaagctttggatggtcatgcgcacctatggtaccgcgaagctccaagagcacatccgtagtgatgttgccatggccaagatgttcgaagatttcgtccgttccgatgacaggtttgaggtggtcgtaccgaggaactttgctcttgtgtgctttcggatcaaggcaagtggagccatgacggaggaggatgccgatcgaggccaaccgcttgctaatggagaatctcaacaagactggcaaggcttatcttgcccacacagtggtcggtgacaaatttgtgactccgatattcgaccaatatggatagtcgctgacagagaagagaagaagagacaatgataaaaaaatgacaatgagacactcaatacaagtagaaccacg

SEQ ID NO: 992 - DNA, 927 bp, Triticum aestivum
gcgggactctcaacacggctggggcggatcactccatgccgggcacaggtcgagtggtacaaggcatcattcgacggcgacatggggtactatgacgcattcaagcaacggaggtcacctaagaagttcaacatggccgacatgtgtcgcatcaagctgggccagttttgggatggtgtgctcgcaatgctcgacaacagccagctgccgcacgacttccatcgccgggccaagtgggtgaatgccgcccggttctaccagctcctcgtcgagccactggacatcgcagactatcaccgcaagaacttccacaagaccagaggcggctacatcacccatggccgggacagcaggtatgagctgttcgacaagtggtggaaggagaagggagccttcactggtacgagcaccggcgacacggctgccacagcgaggagcaagtacgccgggctgactcaggatccatgcttctgggcgagggtggaagaggcatgggatcagactgaaagcgcccaggctgagcaagacgtggcgatgttggcgatgaagctcgggaggctgcgggagttcgagcggtacgccagggtagctggtggagagcataggaggtgtcgatcgacgtccttgcgccgcaatcgagctacacccgctggttggaggagtggaagaagctcttgctctagagacgaagccacccagcgtcgttgttttagttctgatgatgaattagctggaacggctcaagaattttatttttattttcttgccctagttttaggtaacttactataaccctcgctatacgcggttgtaaatacgcataggctcgcagacagacgaggcactgcattacgttgttgtatcagttctgcatcttgcatctgatgctgacttattcagtgtctttcttcagcccaacgttactct

SEQ ID NO: 993 - DNA, 683 bp, Triticum aestivum
  misc_feature (196)..(224): n = any nucleotide
  misc_feature (625)..(625): n = any nucleotide
gcctcctgctcttcgattcccccgaggccccagcagcagcccaacccagccccttcttctgcttcttgttgttgtttttggtgcggtgcgtgagcatggccatcgaccacgagtcgcccttcaaggagctccgcctcaagaacaggaggatcatgggaggcggcgcccctgagccggacgaagaggaggcggagcnnnnnnnnnnnnnnnnnnnnnnnnnnnnncagtggccgcagtggctgcgcccgctgctgtccgcgcgcttcttcgcgcaatgcaagacgcacaccgagtcgcaccggagcggcgagtgcaacatgttctgcctcgactgcgccgccggggccgccgccggggcggcggcgctgtgctcgctgtgcctcgcgcacgcgcaccggggccaccacaccatccagatccgccgctcctcctaccacgacgtcatccgggtgtcggacatccagcgcttcatggacatcgccggcgtgcagacctacgtcatcaacagcgcgcgcgtcgtcttcctcaaggagcgcccccagcagaagcagcccgcaagggcggcggcggcccgggaaggccaacctctgcgaggtctggagcggaagctcctcgacaattccgnttctgctcctcggttgaagggcgccggtgtcccccgagggggcggaccaccaggcagc

SEQ ID NO: 994 - DNA, 634 bp, Triticum aestivum
gtgaggttttggttcttgaatctcgagaggcggaagagaaagagagagcaccagccagcacagactgcgcagtaatggtgatgaaggcgaggttcttggcggcgtcgctcgcggtggcggcgacgtgcgtatgtctggcggcggcggcggcctccgccttcgacgtgccgaccatggccttcgaggaagggttctcgccgctgttcggggatggcaacctcgtccgcgcgcgggatgacagggccgcccgcctcctgctcgatcgccgctccggttcgggattcatctcctcggattactacctgcacggcttcttcggcgcgtccatcaagctgcccagagactacacggccggcgtcgtcgtcgccttctacctgtcgaacggggacgtgtacgagatagacgcacgacgagctggacttcgagttcctggggaacgtcaaggggaaggagtggagggtgcagaccaacgtgtacggcgacggcagcacggcggtcggccgggaggagaggtacggcctctggttcgaccccacctcgaggccaacggtactccatcctctgggccccaccacatatattctagtgacgaatgccgacgcaggtggccggacccggaaggcgggaatcgggc

SEQ ID NO: 995 - DNA, 626 bp, Triticum aestivum
ggcgcgtacaggcagacgcactcgcagaggcggtcgtcggacgacgggtacaactggcgcaagtacgggcagaagcaggtgaaggggagcgagaacccccgcagctactacaagtgcaccttccccaactgccccaccaagaagaaggtggagacgtcgctggagggccagatcaccgagatcgtgtacaagggcacgcacaaccacgccaagccgctcaacacgcgcaggggctccggcggcggcgcggcggcggcccaggtgctgcagatcggcggcgacgcgtctgagaattccttcggagggatggtcaccacgcccgagaactcgtcggcgtccttcggggacgacgacaacggtgtaagctcgccgcgctctggcaacgtcggccgtaacgacaacgacgatgatgagccggattccaagaggaggagagacagtggtgacggcgagggaataaacatggccggcaaccgtacggtgcgggagccgagggtggtcgtccagaccatgagcgacttcgacatcctcgacgacggctaccggtggaggaagtacggccagaaggtggtgacgggcaaccggaaccgcgcagctactaaagtgcccacggtggggtgcccgtg

SEQ ID NO: 996 - DNA, 709 bp, Triticum aestivum
tcgcgcttcgctctcagatccgttctcctccgtctcgcccgcgtgttggggtaggagccatggcggaccagctcaccgacgaccagatcgccgagttcaaggaggccttcagcctcttcgacaaggacggagacggctgcatcaccaccaaggagcttggaactgtgatgcgctcgctggggcagaaccccactgaggcagagcttcaggatatgatcaatgaagtggatgctgatggcaatggaacgattgactttcctgagttcctcaacctgatggcgcgtaagatgaaggacactgattccgaggaggagcttaaggaggctttccgcgtgtttgacaaggaccagaatggtttcatctcggcagctgaactccgccatgtcatgaccaaccttggtgagaagctgacagacgaggaggtggatgagatgatccgtgaggctgatgtcgatggtgacggccagatcaattacgaagagtttgtgaaggtgatgatggccaagtgagctgtcatactaagctagttctatctcgatgttagcagctagtctagccttgaaaactgacagcagttggtactactgttaagtccagtgaatgaacatattgtgcgctcagggatgttgagaatttcgtttggattttctcgcagttgtgtttcctttgtacaatgtagctttctttccaaattgaggtcatgattgct

SEQ ID NO: 997 - DNA, 611 bp, Triticum aestivum
ttttaccgagtcacacataatgcagaacttgcagtccatagcatagtgcgatgcgccgcaggctgcttggtgaagctggcaatctgcctgctctttcagggaataataacctggaaaattcaacaggaatccagagacctgctgatgttctatctctagggactggttcatttcctgcgttcccaaagtcggatggccaaatcctgatgccttcggttccagaatccatagagaatgttgatgctgcaacaccgaagcaggtgcctgccgaagtgacccaatcacccgataaagagtcatccggtgcgaagtatgacatttggacttacgtcctcatatttctagctgcactactgctcattagcctgattattgcgccaatcttggtctgtcggaagcgaggggatggatcaatagccccctggaaagcagggctaagcggccaacttcggaaggcatttgtaacaggtgttccaatagctaaacagactagaactcgaagccgcttgcgaggatttcagcaacattctcaacgctctgcctttctgtaccgtgttcaaggggacattatccagcggagtcgatacctgtgtggtctccatctgccattc

SEQ ID NO: 998 - DNA, 582 bp, Triticum aestivum
gagcccggcgtcgccggcggatcgacaggcgggagcccgacgcggcgccggggatggagggccgcgcgtggggaagccggcgaggagacggtccagggcgtcgcggcgcgcgcccgtgacgctgctcaacacggacaccaccgacgttccgcgccatggtgcagcagttcaccggcatcccggcgccgcccgcgggcgcgttcgcggggcccggcggcgttccggtcatcaacttcggctccgactacggcttcaccggcgccgtccttcccttctccgaccacctccaaccgcgccggccgacgttccaggaccaccaacagctcctccgaccgcagcagcagtacaccggcgcaccgttcggttacggcaacctgcagcaagccggcggcgccggcaccggcgccggcgacatgattcagccacgcgctgagctcggccgaggacaggttgctcctgcagagcctccagacagctcagatgcctacttccgccgctaaccacagcgctaatggttacttcgcctaattaaccaacggttaatcgaagacacatcacaagcaaagaagattcatggaccag

SEQ ID NO: 999 - DNA, 265 bp, Triticum aestivum
ggcttcatcacctggaggtggatcctcacccccggcttcgaccacatgttctcctcgccggtcttccttggcttactcgcgctcctcgcggcgtcgctgatggcctgcacattcaccacccaattgcccatggtgaaggtggccaaaagatggtcgtttatgagttcagggggaagcattaggaagcaagattttgcggaatctcttccccgcgcatctattcaggatttaggggtcatcttgatgggtgccggatatgaggtct

SEQ ID NO: 1000 - DNA, 263 bp, Triticum aestivum
catgttgtacctttgagccttcagatgtatggatggcgagtaattcaaaaggctctggaagttatggaacttgacgagaaaatagatctggtccgcgagcatgatggaaatattatgcgatgtgttcgtgaccaaaatgggaatcatgttatacagaagtgcatagagtgtgtcccacagaacatattggctttgtagtatctgcatttcggggacaagttgctagcctttcaatgcatccatatggttgccgtgttattcag

SEQ ID NO: 1001 - DNA, 258 bp, Triticum aestivum
cacctgctagtccgccatcggctaccgcgtgcccaacgccaccacctacggggacctcctcgcccgcttcaacaccaccaccctcgccggcctcctcggcgccaacggcctcccggtcgccacctcgcccaagaagcgcgtcgccgccaagcagaccgtccgcatccccttccgctgcctctgcgccggcaacggcgtcggccagtcggaccacgcgcccgtctacaccgtgcagccagcagacgggctgtacccatc

SEQ ID NO: 1002 - DNA, 248 bp, Triticum aestivum
cttcgctgaaagcaacaagcttggcgaaggagggttcggtgcggtttacaagggtgtctgatctgaaggtggccaggatatagcagtgaagaggctctcgcagagctccatgcaaggaatagaagagctgaaaacggggctagttctagtcgccaagcttcagcacaagaatctcgtcaggctcgttggtgtttgcttggaggaaacggagaaactactcgtgtatgaatacatgccggaccggagcc

SEQ ID NO: 1003 - DNA, 244 bp, Triticum aestivum
cggcgacgtgctcgtcaactccttccgtgacctcgaaccgcaggaggcggagtacatggagtccagatggcgggccaagacggtcggcccgacgctgccgtccttcttcctcgacgacagccgcctgccgtcgaacaaggcctacggcgtcaacttcttcaacagcgccgcgccgtgcatggcatggctggataggcagcctccttgctcagtagtcctcgcgtcttatgggacggtctacagc

SEQ ID NO: 1004 - DNA, 243 bp, Triticum aestivum
gacgtctggagcgacgccgtctcctcccacgccccggaacacctcctcgtcatggtccacggcatcctcggcagtaccaatgactggcaatacgcagccaacgaatttgtaaagcagcttcctgatgatgtaattgtgcattgcagtgagaaaaacatgaacacattgactctagacggtgtcgatgttatgggagaacgcttagcagatgaggttcttgatgtaattagtcgaaagccagac

SEQ ID NO: 1005 - DNA, 227 bp, Triticum aestivum
cgcggcatcaaggtcctactctccatcggtggcggcgtcggcagctacggcctctcgtccgccgccgacgccaagcaggtcgccgactacctctgggacaactacctcggcggcacgtcggcgtcgaggcccctcggcgacgcggtgctcgacggcgtcgacttcgacatcgagagcggcggcacgcgcactgggacgcctggcgcgggactcaagaagtctcgggg

SEQ ID NO: 1006 - DNA, 227 bp, Triticum aestivum
caagaagagcaatggcagcaagggcgccgtgcagctgccgccgagccctccggccatcgggttcttcggccacctccacctcgtggagaagccgctgcacgccgcgctgtgccgtctgggggcgcgctacgggccggtcttctcgctgcggctcggcgcgcgcaacgccgtggtggtgtcctcgccggcgtgccccagggagtgttcacggagcacgacgtggcctt

SEQ ID NO: 1007 - DNA, 805 bp, Triticum aestivum
ccaagatcaaagccaacgacaagacacagcaagcatgttgcagtaattcttcagctgggtgacatgaaccaccgcaggtttaggaacatttcaagcacaaatgattcatggaaggaagtttccgaagaggttgtagtctaccagctattgccgaacttcattgtccatgttactcttgagcatctatcactgcttttctaattcacatttctgctgtcagggtcgtatggctttcgataaactgttcagtagaggaaagcttccccaaagcttttctcctccacaagcagaaggattgaaggtggtacccaggggggaacaagacgaagctactacggtgacggtcgacctcaacaagaggtgctgcagttatggaccatgaacttgatacattggttgggccaagagctgctacctttcccattgaattgtcacacctgaatatgaaatcccgccggacaggcttcaaaccttacaagaggtgctcggtggaagcaaaggagaatagggtgccggcttctgacgaggttggtaccaagaggattcgtcttgacagcgaaccctccacgtgatttacttgctacgacatgattaccagccttcacgagtagtgtattttcaagaaattgcagtatttacatctaagctactactataggacttctcagtccttgcaatgcagtgtttcacagaactcaatttattatgtgttgtatgttaatgcttgccgagcagcccttctagactctcaattaagcattaagcacctacgcatgctactttattggtaaaaggcaattatgct

SEQ ID NO: 1008 - DNA, 1042 bp, Triticum aestivum
ttgcagtgcttcggtttcaaatgcaaattaaacaagaactggagtctatggcttcacggcttgaaactatcccaggcagttctgaatcacccagcgacccctttcctcgtgataatgttctagctgatgcagaatctgccaaggaggccaaggacaaggcgaaagagctttcactgaatcttaagagcattactcaactatacaacgactatgctgttccatttaatctttgggaggtttgcctggaaatgctcaactttgcaaattactctggagatgctgatagcaaaattgtccgggaaatttgggccagactccttgaccaaacactgacaagaggtggtttagcagaagcatgttctgtggtgaaaagagttggctcaaaactagatcctgcagatggagcttgtttacctttggatataatatgccttcatcttgagaaggctgcattggataggttaagttcaggacaagaattagttgttgatgaggatgttgcaagagcccttctcggagcctgtaaaggtcaagccgagcctgtgcttgctgtgtatgatcaactgctatcgaatggtgcaatcgtgccctcacttaatctgaagctgcggcttctgagatcagttctcgcaatccttcgcgaatggggaatgtcggtcattgcccataagctaggcaccacaactgctggggcttcgttctttttggatggaacattttcgctgaatcaaacagggtctttgcagaaaggtgttcgagataaaataattagtttggcaaacaggtatatgactgaggtgaggcgattaaatctcccacagaaccaaacagataatgtgtaccgaggtttccgtgacctagaggagaaattgttatctccttactagccattctttatttgtcctctcaacattgtaaagtgtgggatgcacatttgttgttgtaccaagtatgggaataaagccaagacatcttgattcaactgggcatcgatctctcatacgctgtttatccatctagtggaattttgtgcaaaacgcca

SEQ ID NO: 1009 - DNA, 451 bp, Triticum aestivum
cggaggggtggtcgaagcggaagcggtcgaggcggcagcgcgcgctcgaccccagcgaggaggagtacctcgcgctctgcctcctcatgctggcgcacggccaccgcgacagcgcccctgctgccgcgccagagcagcagcacgggtgctccgtctgtggcaaggtgttcgcgtcctaccaggcgctcggcggccacaaggccagccaccggaagcctacagcggcgccggctggcgcagaggaccagaaaccgctggcggcggtggcggcagcttcctcgtcggggtccggcgaggccgcggtcagcgccggaggcggcaaggtgcacgagtgctacgtgttccggaagactttccacgactggcatgcgcttttgcggacacaagcgtgtgtcactacgaaggtaccatcggaagggccgccggagggtccacgcagaagctgtgcgca

SEQ ID NO: 1010 - DNA, 950 bp, Triticum aestivum
ccagttcgagctgctcgtcaaggtctacttcaaggacgagcaccccaagttccccagcggcggcctcatgacgcactacctggactcgctccatgctcggctccttgcatgagaccgtcaagggcccgcttgggtccacgtggagtacatcctggccgcggctaacttcgtcatcaactgcgcaagcagcggcgggcgcggcggctggccatgatgctgcggcggcagcgggatcacgcccatgtaccaggtgatccaggccgtgctgcgggaccagccggaggacgagacggagatgtcacctcgtgtacgcgaaccggagcgaggacgacatcctgctgcgcgacgagctggaccggtgggcggcggagtacccggagaggctcaaggtgtggtacgtgatcgaccaggtgaagcggcctcgaggaacgggtggaggttcagcgtcggtttcgtgacggaggacatcctgctgggcgcacgttccccgagggcggcgtacgtacaccctcgcgctcgcctgcgggccgccgcccatgatcaagttcgccatctcgcccaacctggagaagatgaagtacgacatggccaattcctttcatctccttcatgatgaaacaacatcatgtctcctcctctagtagcgtagcatgcatgcagctgcctcagctacgtaaataccaccgcgtcgacgcatcaatctgtgcatgtacccaaaggttaaaagggttcgttggaaagtatttgtttcattagagaaccgtatgtacgtgcatgcgtacgtgattgcaatgaaattatactcggtaggattgtaatgaacgtacgtacacttgtttcctagagtacattggacgtggcttcggttgagggtctgtttattccttcatgtacactacctagtatgtaaataagattgattattcttctatctaatatttaaagccgtg

SEQ ID NO: 1011 - DNA, 771 bp, Triticum aestivum
atcgtattggctacctatatcccccctattctcagttctgcacggcacagcacagcacagcacagcggtagaagaggaaggtagagcagagatgactgcgtccgtttcctacggggctgcgagcacttccggacgtggtccagtctctgtgtccggtgtacgtacctctgctcgggcgctggccatgtcggttgtcggcgcgggggccccggtggtacgcggccccttcgggacgccgtgcgtaggatgggctaatgtatacgagggcttagggcatcttcgcgcccctggtggtggtggtgcgcaaacatcgtcggacgcatagcgcttcaaccagctcaggggtcaaggccatcgctgctgctactcccaggtgattaccgtagttctgtaagaccatcggcgctgaccccatagcagtaggcagggcttgatccgcctcgccaagaagaaacggagagaagctcggattccttgcttgaccatgcctcacaatccccctttccttcatcatacacattttctaactagcaaaaaaggaaacttaccttggaaattggaagaattgacaatgcatgcatgtatgtatactagtcttatataatttttcttcctctcttctcttctcttctcttctcttgtggagacagcactgagttcagttaaagttcagttcagttccatgtggaatagagtggaatggacagtatgatgtatctatcctctactgatgacctcagcggacagagtatatatatgcgcaatgctact

SEQ ID NO: 1012 - DNA, 923 bp, Triticum aestivum
cgtgaggagcaggatcctggccacggtgagcaggagggacgccttcctccaccggctcatcgacgccgagcggcggaggatggaggagggcggcgacgatggcgagaagaagagcatgatcgccgtgctcctcactctgcagaagacagagccggagctgtacaccgatcagatgatcatcgctctgtgcgcgaatatgtttgtggccggaacggagaccacctcaagcacgatcgaatgggcgatgtcgctcctgctgaaccacccggcggcgctgaagaaggcgcaggccgagatggacgcgtccattgggacctcccgcatggtcaccgccgacgacgtgccccgcctcagctacctccagtgcatcatcaacgagacgctacgcctgtacccggcggcgccgctgctgctgccgcacgagtcctccgccgactgcaaggtcggcggctacgacgtgccgagcggcaccatgctgatcgtgaacgcgtacgccatccacagggacccggccgtgtgggaggacccgacggcgttccggccggagcggttcgaggacggcaagggcgacgggctgctgctgatgccgttcgggatggggcggcggaggtgccccggcgagacgctggcgctgcagacggtcggggtggttctggggacgctggtgcagtgcttcgactgggaacgggtggacggcttggaggtggacatgacggagggggtggggatcaccatgcccaagtccgtggctttggaggccgtgtgtaggccgcgcgcggccatgcgtgatgtccttcaaaagctctgaggatcgaacttcttggcatcccatatgtacagtagtttccagtagcatcgtgccgtatgcatggctcgataccgttttgatgtaccgaataaacttgttgcgattcggaccataa

SEQ ID NO: 1013 - DNA, 992 bp, Triticum aestivum
cggctcgaccaagatcgattgattacgttacgtgaagtgcgtcgatcgatccctaggaaggaaggaagaaacaagcaagaataggatagaatgcagggcgaagtggagcagcaggcgccgatgcagatggtgctgcgggtgaagcacccgtcgtcgctgtccagcggcagcgaggaggcgtcggagggggaggggtcgtccaggtcggcgctctccgtgttcaaggccaaggaggagcagatcgagaggaagaagatggaggtcagggacaaggtcttcgcgcagctcggccgcgtcgaggaggagtccaagcgcctagcattcatacgacaggagctggaagggatggccgatcctacgaggaaggaggtggaatcaatacagcggcggatcgacaccgtcaaccgccagctcaagcctctcagcaagagctgcgtcaagaaggagaaagaatacaaggagattctcgaggcgtacaacgagaagagcaaggagaaggccatacttgtcaacaggctaatagaggtgacctgacctcaacatcatgcatgcatcacctcgtcttcttcttaattactccctctggttcccccagcgacaagtattgtggtgcaagggagtagttaaatatatcagcttccacattattagtactgaccactttactcggctcttcatgtgcagctggtgagcgaaagcgagaggatgaggatgaagaagcttgaagagctcaacaagacagttgattcactctattagacgtaatgataccagcttaatgttaattaccacccctgagagcttaatttcgatgtgcaatctccgtccatcccatgaatttgtggcatgtccttgttgcatgtatgtgatctgtacgcgtcagcttgtaactcacaccatgtcgtgagcaattcttctttaattttcgcctttcttcttgcttgcttccttgtgattgacgaccgggtttgagtccatctcttgttgcactg

SEQ ID NO: 1014 - DNA, 579 bp, Triticum aestivum
gtggttggataagaagatctgcaccaccgacgaaccagcggggaagaaagcagaggttacagaggcagccgcggcaaggagcagagcagagagcgatggccgaggctgcggggagcggcggcgtggtgaagcacctcgtgctcgcgcggttcaaggaggaggcgactccggaggcgctggaccagctcatccgccgctacgccggcctcgtcgacgccgtcccctccatgaaggcgttccactggggaactgatgtgaccgtactggacacgcatgaagggttcacgcacgtcttcgagtccacttttgaaagcgcagagggggtcaaggagtacatcgcacacccatcgcatgtagagtttgtagatgaattcttggctttggcggagaagatgctcataatggactataagccggcaactaccaattaataacttcggccaagtgagactctgggagcttctgttctcgccctgggtgatttgtttgtagtatttgtgtttggatttcatttggtatccacaagacatgtataccttgtgctaaacaaatctgtccagccttctataatctgcgagc

SEQ ID NO: 1015 - DNA, 1149 bp, Triticum aestivum
acatcagttcagctaggaactactattccattcactcatttatttcaatataaagcatacaaaacatgaaacctgtctttcttttatgcgactacacatgaaaactactctacccaccaatggcgctcgtatgcagtcggccagcctccctcctactcatcgcggctcttctctccgccgcaaccttccttgccgtcccggccgcggccacggggaagaccggccaggtggccgtgttctggggtaggaacaagaacgaggggtccctccgggaggcctgcgacaccggcacctacaccatcgccatcatctccttcctcgacgtcttcggccgcggcaactaccacctcgacctgtctggccacgacgtctccgccgtcggcgccgacatcaagcactgccagtccaagaacatactcgtcttcctctccatcgggggcttcggcaaccagtactccctgcccaccgcccagtccgcggcggacgtcgccaactacctctggaacgcctacatgctcggcacccgcaagggcgtctaccgcccgttcggagacgccttcgtcgacggcatcgacttcttcatcgagaacggcgcgccggccaactacgacgagctggccaagcggctatggaacttcaataaggacttccgcggcaggacgccggtgcagctgacggccacgctgcggtgcggctacccggaccggcacgtggagcgggcgctcgccacggggctcgtcggacgcatcttcgtcaggttctacgacgacgccgactgcgccgccaactggcagcgacagtgggacaagtggacggcggcgtacccttcggcgcagatctacctcgggctgccggcgtcggagcagaaggtcggttacgttcacccaaagaacctctactacagcgtcatacaggtggcgcagaaggcggccaactacggcggcgtcatggtgtgggaacgctacgaggacaagcggaccaactatagcagctacgccatccaatgggcttgagcctccgtcgctcacatccgtcaccgtgtgtgaatttggtgtatccgtctgtctactgcatactctgcatgtgtttgcttaccttacggtaaataagtatcaccagtgtgagaacggcgtttcggtgcccgggtgc

SEQ ID NO: 1016 - DNA, 888 bp, Triticum aestivum
gaggacgggatgctggttgggagggaccggctggaggagcttgtccgggagggcaagaagatcagacgggctcgaaagaagggtgtttttccggttgatggcgacagtgacggagggatgatgaggaatatgataatgtagcagagggttcgtcagagttggatggtgatttcggggacctgtttgaagaagacagtgtcgctggggaagactggaatgaggtgggtgatggaggcggaatcgagggggatggcgacgacgaagatgatcctgaagctgatgccatggaggagttttgggtgaagaaggctgcggaggaggggctggttgacagtggcaccgagcatgatgtttggtgaggagtgtcgagatgctaggatttatgcacatgctgtgaccatggattgctcaactgcattcttctcagcgatattcagtagccagaagtattagtacataacttgggagcttggatactgaaggcgagggtgaagggtggttcgaatactatggcctgtctgaggcataattttccactttcctctgtccatggaggcatgcacctccaggacaacaatgtcctagcgtctgttgatgctgtcagaaccatcgacaaggatgctgtagagtctgcgatgaccactcccaagctacgacatacagaatatggtcgtcaatattgcatctttgtacctctggattaccgaaatgaagaacagaagtggaaactaaaccagcactcgaggactgcaggatcaccgctcgtgaaagcctgcaattcaagtgttccttatactacaactgtatgtatacatttatttattttctacaattaattgatggtcatatttttgcatgaacatttgcatacgtacaaggcaggcacag

SEQ ID NO: 1017 - DNA, 326 bp, Triticum aestivum
ttagcgtggaagaactgagacgttgagggatccatgtggtaaaactgcagaagttctacaccagagagggtaactttgaccttgttgggaacaacaatattgtgtttttcatccgagatgggatgaagttccctgacatggtccatgctttcaagccaagtccaaagaccaacatgcaggagaactggagaatagttgacttcttttcggcaccacccggagagtctgcacatgttcaccttcctatttgatgatgttggcattccactcaactacaggcacatggacggttttggtgtcaacacctacaccttaatcagcaggga

SEQ ID NO: 1018 - DNA, 262 bp, Triticum aestivum
ccactccccaccaccccctcagccatggcggtcgtcgagccggtgcccgggggcgacgtgaagctattcaaccgctggaccttcgaggatgttcaggtgaccgacatctcgctgaacgactacctcgcggtgacgtcgatgaagcactacaccttcctgccgcactcggccggccgctactcggccaagcgcttccgcaaggcgcagtgccccatcatcgagcgcctcaccaactccctcatgatgcacgggcgcaacaacg

SEQ ID NO: 1019 - DNA, 657 bp, Triticum aestivum
ttgtatttcgctccagcccggcaggaaaagaagcttcgctccgccgcccgcgtataatacaagaacccaagaagcaaaatggaggtggccggcgcgctggcctccgtcctcttcgccgccttctcgctcccctgcctcctcctgctcgtcgtcgtggccgaggccggcctccgcctcgccgcgctcgcgctccgcggcgaggcgttcgcgtggccgtcgcgctccgccttcctcggctaccgcatcgcgcgggccggcagcttctcctccgccgccacggccgtcggcggcggcgtcttccagcaggaggagctactgccgcccgagtacctggatctcctcgccgtcgcagtgtaccgccgcggtggagacaagtgggcggccgtggaactgcgtgttctgcctgtcgcggatcgacgacggcgaggaggtgcgcgagctccggtgccgtcacatcttccaccgcgagtgcctcgactcgtggctcctctgcccgcgcgccacgtgcccgatctgccgcgaaccgcctcctcacctgagagcctccccgcgccaagagcaagcgccctagaagacgacgaaataaacgatacgaacgagcacgaagacccgcccatccacctcctcctcgtcctactcaccatgaaaaccgcgacg

SEQ ID NO: 1020 - DNA, 1044 bp, Triticum aestivum
tccgtcctacgatcccaatggcccacgtcctcgccgccgccgagcccctcaccctcctcaagcgcccgccgccgcagaacgacggcttcggcgacgacaacggcagcacggaggagaaggcgcccaaggcgcgccgccgggagtcggacccggcggctgcactggccgcggcgcggcatgagttcggggagcacggcggcgtgaacatgtccatcgaggcctcggccacgttcaccgtgatggagccggacaccatgcgccggctcttcacgggggagctgggcccggagcgcggcgacctgtacatctacagccgccacttcaacccgacggtgctggcgctggggcggcagatggccgcgctggaggggaccgaggccgcctactgcacggcgtccggcatgtcggccatctcctgcgtgctgatgcagctggtgggcgccggcgggcacgtggtggcgtcgcgctgcctgtacggcggcacccacgcgctgctgtcccggttcctgccgcgcacctccggcgtgcaggcgacgttcgtggacgcggacgacgaggcggccgtgcgcgcggccatcaggccgggggagacgcgggtggtgtacgtggagacgatgtcgaacccgacgctggccgtggccgacatcccgatgctggcgcgggtggcgcacgaggccggggccaagctggtggtggacaacaccttcacccccgtcgtcgtctcgcccgcgcggctcggcgccgacgtcgtcgtccacagcgtgtccaagttcatcagcggcggcgccgacatcatcgccggtgcgatctgcgggccggcgagcctggtgaactccatgatggacctgcaggacggcgcgctgatgctgctgggccccacgatgaacgccaaggtggcgtccgagctggcggctcggctcccgcacctgccgctgcggatgcaggagcactcgcgccgcgccgccgagttcgcggcgcggatgcggcgcagggctccgcgtacctacccgggctcccggacaccgaaccacgccggttggcgca

SEQ ID NO: 1021 - DNA, 539 bp, Triticum aestivum
cggcgccggagtacttaacgcacggcatcgtggacgagaagacggacgtgttcgccttcggcgtcttcctcctcgagctcatctccggccggaagcccgtcgacggctcccacatgagcctcctcgcctgggccaagccttacctgaaggacggcgtggtgcaagggctggtggacccgcggctcggcgacggcggctacgacgccggccagctccggcggctcatgttcgtcgcctcgctctgcgccagggccgccgccgcgtggcgtcccaccatgacagaggtgctggagctgctggagtcgtcggacgagatatcgcaggagcggtggcagatgccggaggaggcggtggaggacgaagattactagggaacttatgacgacctcaacacgactatacgaggacgacgatgacgacgaacatacgaactaacgaacggcgaatcggattccccctcgaaaccctcgatcggcgtgcagcatccgcgccaatgaattgaatagcaatagcccccacccggatcattatattagcag

SEQ ID NO: 1022 - DNA, 1542 bp, Triticum aestivum
tggaaaggcagcgccgtgaggaggaggtgaaaactaaatcatctaagaaagcacaagatgctgagcaagccatgatgaacaaggagcaagctaagtcgtcaaaagacaaatccaatcagcaagataaagataccaaagagggacctaatctgcaggttgctggtcctggcggcgaaataactgcaggttacctattgaaaaagagtgcaaaaaacaatgaatggagcaaaaggtggtttgtcctaaatgagaagagtggaaagcttggctacaccaagaaacaagaggagaggcattttcgaggcgtcattgtcttagaggaatgtaacctggaagagatagaggaggaagagctttctaaaacttctaaggattcaaagaaggcgaatggggcagagaaaggcccaagtctcgtatttaagattactaacagggttgcctacaaaactgtgctgaaagctcatagtgccgttgtattgaaggctgagagtatggctgacaagattgaatgggtgaagaagataaaaggtattattcagagcaaaggtgggtctgtcaagagttcaaatactcctgagggcggttccatgagacaaagccattcagatggatctcttgatacgatggcccggaggcctgctgatcctgaagaagaactccgatggatgtcacaagaagttcgtggttatgtcgaggctgtgttgaacagcctggcagcaaatgttccaaaggctattgtgctttgccaagtggagaaagcaaaggaagatatgctaaaccagctgtacagctcaataagttcacaaagcaatgcaaggattgaagaacttctccaagaggaccacaatgctaaacgcagacgggaaaaggcccaaaaacaatcgactcttctgtcaaaacttactcgtcagctcagtgtccatgataacagagctgcagttgcatcatattctgatgatacttctggtccggagagtggcccacagagccctagccagtcgagtgaggactggaggtctgccttcagtgctgcagcaaatggctctgccgaccgatccagttcacagaacgagtcaagatcgagaagtgctgacagtcgtggtcggcggtatgaaaatggggatgccaacggtgccaattcaggcagccgacgcacaccaaaccggttgccacctgcaccaccgaaatactaagcatgttgattggcatatgtgagaatcctatttttcatggcatgctctcactcccacctgatagtgatgggaaaacaaattggaatgagaatagagagctggcgagagatcgcatgaatggtgtgtatccagaggacctcagttgtttatagaaatatgtaggttatctacggtggttgtttcgcgatcattttgctatatcgatcagtctgatgctctctcggcctgtgagattttgttgccacagatcagttgatcttggttctgaactctgttgttgtaacttgtaagtcttccatcaaactggcatgtatccttttcacccattggtgtattatattctttccag

SEQ ID NO: 1023 - DNA, 673 bp, Triticum aestivum
gcaacctcaccgccaaagttgcggactttggggcgtcgaacctggcgcctagtgatgaagccgagattgcgacattggtgcaaggcacctgcggatacctggacccggagtacctcatgacatgccaactgactgacaagagtgacgtgtatagctttggtgtcgttctattggagcttctgacaggaaagaaggtgatctgcttcgatgggccagagcagggcaagagcctcgtgtcccgattcacgacagccatgaaaaccaaccgacacgatgaggtccttgatagccgggtgaggaaggagatgggctccaaggcattggaagaagtcacacatcttgtgatgcgatgtgtgagcatgagtggggaggagcgaccagcaatgaaggaagttgccgagaggctagatgcattgaggaggtaccagcagaacccatggggtcaggctggtgccggaggtctggaggaggggcaaagcttgcatggcagggagcaacaacgtgatgtgacttataagtttatacctcaagatgtgcttgatgttgaagagggcagtacatacacatttagcatgtagattcatctattgttgttcgtgacccttttgcaatgtgtgactccaaatgtgtgattgagttggggtggctagttaggatcaggtgactgaggtgt

SEQ ID NO: 1024 - DNA, 1052 bp, Triticum aestivum
tacaacagctgaagttgcatcatctcgagctattagtctgcgaaggatattgatccagatggttcgagaactatcggtatcttaagcaagattgatcaagcagatggagacgcgaaaactatagcttgtgttcaggcccttctcttgaacaagggcccagaaaaccttcctgacattgagtgggtcgctctggtaggacaatctgtagcaattgcatcggcacaatctggatcagttggttctgagaactcgctggaaacagcatggcaagctgaagctgagaccctcaagtccatcttaactggagctccccatagtaagctaggtagagtttctctggttagcaccattgctaagcagatacgtaaaaggatgaaagtgcgtcttcctaacctattgactggccttcagggtaaatcccagatggtgcagctgagctggccaaggctcggagaatctatggtacaagtcctgaaggaacccgagcagttgcgttggagctgtgccgggaatttgaagataagtttcttgctcatattacatctggcgaggggtctgggtggaaaattgttgcaagttttgaaggcaagtttccagacagaattaaacagctaccattggacagacattttgatctcaacaatgtcaaaaggattgtcctggaagccgacggttatcaaccatatttgatatctccagagaagagggttgaggtcattaataaaaatagtactagacatggcaaaggagccatcacgactatgtgttgacgaggtacaccgtgtattgttggacatagtcaatgcgtccgctaatgccacacctgggcttggaagatatcctccattcaagcgtgaggtcattgcaatagcatcgaatgcattggatagctttaaaagtgacgccaaaaagatggtagttgctcttgttgacatggagcgtgcctttgttcctgctcaacatttcatccgtctagtacaaagaagaatggagaggcagcgccgtgaggacgaaatgaaaaaccgaccttccaagaaaggacaagagtctga

SEQ ID NO: 1025 - DNA, 618 bp, Triticum aestivum
ccggccgcgttccatgggtgtccttcgaggtgatctgccgtccctggcgtggggtgctcattttttcggctcggtgatcggtgccggcgctcaaggaagactgtccccggcgagcggcgagccgtcgcagctgcggcggatgggcgccgggcggctgctcatggcgttcgcgatggccgtggcggcgctggtggagatgaggaggctggaggccgtccgggagcggggagtccatcagcatcgggtggcagatgccgcagtactttgtgctggccggcggggaggtgttctgctacatcgcgcagctggagttcttctacagcgaggcgccggagtcgatgaagagcatgtgcacgtccttcgcgctgctcaccgtggcgctgggcagctacacgagctcgctgatctacgccgtcgtgaaacgcgctcacggccaccggcggccggcccgggtggatatcggacgacctcaacgaggggcacctcgactacttcttctggaccatggcggcgctgtgcacgctcaacttcgtcgtgtacagcgccttcgccaggaactaccaggtgaagacggtcgtgtcgtgatcgtgatcgtgatcgtactcgtcggcgtacata

SEQ ID NO: 1026 - DNA, 513 bp, Triticum aestivum
gattccaataaaaagttgggaggatctgacaagtgacaaggatgcaattgaagccataagagcaatatatggagatgatgtagagaaattggatcttcttgttggtcttatggcagagaaaaaaatcaagggatttgccataagcgaaacagcattcaacattttcattttaatggcatcaaggaggctcgaagcagatcgatttatgacaagcaatttcaatgagaaaacatacaccaagaaggggatgcagtgggtcaaaacaactgaaggcctacgagatgtgatcaaccggcactaccctgaaattactgccaactggatgaggtcctctagtgctttctctgtgtgggatgcagactactagtgcaaaaataaaaggccccctgccatatgtagtgcatgcaatttggcaagttctatgaagtatcatttgttcacaaaattattgtgtttgttcagtgtaaataaatatacttaaatatgtcagtgtaacatatgtaataggttaat

SEQ ID NO: 1027 - DNA, 1052 bp, Triticum aestivum
ctcgaaccgaaacgtattgcgattacatagtgacagtactcggaaacaattaacaggaagggttcagtttccagtcccccaaattacaacctctctcgccgtctgctcgctcgcccgtcccccaaatccctactcccccaccaaccccagccgaaccccggcggcgtcaccggcgatggagtgcgtcatcggcgtggtcggccgcgacttcgcggtcgtggcggcggacacgtccgccgtgcagagcatcctcgtccacaagacggacgaggacaagatcatgctcctcgactcccacaagctcatgggcgcctccggcgagcccggcgaccgcgtgcagttcaccgagttcatccagaagaacctccacctctaccagttccgcaacaacatgccgctcagcaccgccgccaccgccaacttcacccgcggcgagctcgccaccgccctccgcaagaatccctactctgtaaacatcatacttgcagggtttgataaagacgctggtgcatcgatgtactacattgactacatcgcgacgctccacaagatcgacaagggagcattcgggtatgggtcgtacttctgtttgtcgctgatggacaagttgtaccgccctgacatgactgttgaggaagcggtggaccttgttgacaagtgcatcaaggagatcagactccggctggtcgtcgcgccccagaatttcgccatcaagatcgtggacaaggatggcgtccagggactatgctaggcgtgagatcggaggtgacagtcctgcaaccgcaaccgcaacaatagcaacaactgcctgaggtgattggccctgtcggtggtcatttggaggctggagactgaacccttcctgttaattgtttccgagtactgtcactatgtaatcgcaatacgtttcggttcgagaactgtgttgcaaattctcccagctgtggactatagtctgtttatgaccccccatttcatggttatatgtttcactgtttcttgctattgaatgctgtgctccgggtactctggacttcctgctaatgactgct

SEQ ID NO: 1028 - DNA, 736 bp, Triticum aestivum
cgtgaagattgcagattttggtgtctctcgtcaacgatcgcaagagggagatatgactgctgaaactggcacctacagatggatggcacctgaggtgataaaccataagccttatgatcacaaggcagatgtcttcagcttcgctattgttctatgggagttggtcacttcaaaggtcccgtatgagaacctgacaccattgcaagcggcactgtcagtaaggcagggacttcgcttggtgattccctcgggcgtgcatccaagaatatctaaattgattcgacggtgctggggcgaaaaccccaatacacgacctgttttctctgagatcaccgcggaacttgaagatatcttgcagcctattcaggccgcctccagctccaaaggaggccatcgacataccaaacaaaagatacagatgaaaacacagcgatagaaagaaggcgcctgctcatgaagctggaccctcttttgacattgccacgcactaaaaagtgcgacatgcgcacatcgtctcctgtatatatgtcatgtacataaatttttgtgctcggttggtttgaattccccttaaaaggttcacaggacgaactgggttaagttagaacacccgtgctacataacctgagtgatatagttttatgtttaatgtggttatttgttttgcgagtggcttatagttcggtgtgtttgattttgggtcatgtacgattatgagttcgtcttgtaagactat

SEQ ID NO: 1029 - DNA, 843 bp, Triticum aestivum
aggtgttcgaatatctctactgatcttcagacgatgaggaccaggcctacaggtagatcagactccgtgctgaggatgtgcaaggggatgaatgtcctcacaaacttctgggggcatggacttcaccactgacaagctcaggtctcttgtgaggaagtggcagacactcattgaggctcatgtggatgtgaagaccactgacaactacatgctccgcatgttcgccattggcttcacgaagagacgcccaaaccaggtgaagcgcacttgctatgcccaagcaagtcagatcagacagatccgccgcaagatggttgagatcatggtcaaccaagctgcaagctgtgacttaaaggagcttgtgaacaagttcatccctgaggtgattggaaaggagattgagaaggccacctcaagcatcttccccctccagaacgtgtacgtccgcaaggtgaagatcctgaaggcccccaagtttgacctggggaagctcatggaggtgcacggtgactacaaggaggatgttggtgtgaagcttgacaggcctgctgatggagatgaggtgattcctggagcggaggaggttgctgctgctgagtagaaaatagaagtcgctattttgctgcttcatatctagaagatgatatatgtgccacctgggtgtcgtgaactttgtagtcagttttgatggctgatttcttgagtacttctgtcgacattcctagccagcgttcagttatcttattttgttcgtgttactttctggatggaggttatgagtttaaaactaaatatttagtttattcctgtcctgtgtgttttatgtttgaatggaacttatgc

SEQ ID NO: 1030 - DNA, 501 bp, Triticum aestivum
cttctctgtggacctcgcgggccacgtggtgggcgcaccggagtactgccacgccaacttcaccaactacttcacggacacattttggatggaccgggcgctcagcggaacattccacgggcggcgcccgtgctacttcaacaccggcgtgatggtgatggacgtggaccagtggcgcaccggcgggtacacgaggcgggtggaagggtggatggccgtgcagaagcagaagagaatctaccacctcggctctctgccgccgttccttctggtgctcgccggggatatccaggccgtggaccaccggtggaaccagcacgggctaggcggcgacaatgtcaaagggcggtgccggggcctgcacccgggacccatcagcctgctgcactggagcggcaagggaaagccctggcaccgtctcgatgcccggcggccgtgcaccgtcgactacctctgggcgccctacgacctctaccggccatcgtcgccggtacttgagga

SEQ ID NO: 1031 - DNA, 861 bp, Triticum aestivum
atggttgttctggagtctgccggagatgccgctaatatccaagtattgagtgataatgaaatcattgttgacaactgctgcatgcaacttgtttcaaggcctgagcagtttgatgttatggttacacctaacctttacggcaatttggttgccaacacagctgcaggtcttgttggaggaacaggtgtcatgccaggaggtaatgtgggtcaggatcatgccatcttcgagcaaggtgcttctgcaggaaatgtgggaaatgacaatcttgtagagcagcagaaagcaaaccctgtcgccctgctcctgtcgtccgcgatgatgttgaggcatttgcagttcccgtcgttcgctgaccgtctggaaactgcggtgaagcgggtcattgcagacggcaagtacagaacaaaggatctgggcggcaccagcaccacccaggaagttactgatgcagtgatcgctaatctggattagatacctgatgcacgcctgcagaatcgattcttttggaggactggtttacaggtcccaacttttgagtgctattttttccgtacagcgttagatcggcaattatatatttcagaaataattgagaaacccacgaggattattcttcccacgatactttgtagcaaggcaaaacaccttgtgttgcagaggggatagctgtctaccttaaatttaaacggcatgcattgaaagtttattctcagttcttattcgtggttgtcactcccatgtaaccggaatcgggtcctcttttctttggaaagggaatctggtcttctgaattgctatgcatgtcactgtcagattttgtatggtactcgagctatagctcccaaatcctgtccccct

SEQ ID NO: 1032 - DNA, 775 bp, Triticum aestivum
gtgatcttaagcttacacactcaccccctgtcgctactgtgcctctgggaaccggaaacaaccttcctttttcatttggatggggaaagaagaacccagctactgaccaagaggcagtgaaatccttccttgggctagtgaaagaagcaagagaaatgagcattgatagttggcatatcatcatgaggatgcgagttccacaggaaggtccatgtgatcctattgctcccttagagctgcctcattcactgcacgcgttccaccgtgtaactggctctgatgagctcaatgtggagggttaccacacattccgtggaggattttggaattactttagtatgggaatggatgctcaagtgtcgtatgggttccactctgaaaggaagaaaaatccagagaagttcaaaaaccagctatcgaatcagggtacatatgctaagcttggacttaaacaaggatggtttgctccttctctaacccattcctcttcaaggaacatttcgcaacttgcaaaggtgaagatcatgaaaagacctggtggccaatgggaagagcttaaaatccccagcagtattcgatccgatatctggctcaaatttgccaagttctccgcgatgatcaatccctggggaaccctgggacgggagaaacagaacggactgcgggccctaggggcgaggggccctaggggcgggcccgaagcgaagggcatgtgaggcccaagaagaaacgctaaggcaaaaggcggatcacaggggacactatggcgcgcaac

SEQ ID NO: 1033 - DNA, 1090 bp, Triticum aestivum
ggagaaggagcaggcggcggggtgcccgaagacgagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgccttcctctgatcctcatcctgaggaacagactgaaatatgctctcacctaccgtgaagtgcagtctatccttatgcagcgtcatatcatggttgatggaaaggtccgcactgacaagacctaccctgctggtttcatggacatcatttccattcccaagactggtgagaactacaggcttctgtatgacaccaagggccgcttccgccttcactctgtcagggatgaggatgctaagttcaagctctgcaaggtcaggtctgtccagttcggccagaagggcatcccctacctgaacacctatgatggccgcaccatccgctacccagaccctctcatcaaggccaatgacactatcaagctcgacctggagaccaacaagattgttgacttcatcaagttcgacgttggtaacgtggtcatggtgactggcgggcgcaacactgggcgtgttggtgtgatcaagaacagggagaagcataagggaaccttcgagaccatccacgttgaggatgcccagggccaccagttcgccacccgtctgggcaatgtattcaccattggcaagggcaccaagccatgggtgagcctccccaagggcaagggtatcaagctcaccatcattgaggagcagaggaagcgggatgccgctgcccaggctgctgccaaggcctgattctgaggcgttgagtcgttttgctatagccagttatctgcaaggatatagaactatgttcctggaaccatcgtttttaagttttgcctgatgtttgttgatttgcgaactcgtggttgcctctagatgtaatgtggatgtttatcttattaagtgctatttcgagacctcatccggttatcttaaatgttatctgataaaatgctctctgtttaaagttggaag

SEQ ID NO: 1034 - DNA, 708 bp, Triticum aestivum
ctttttgctactgttgctttcgcagctatattcactgtacctggtggaaatgaaaacaatggagttgcgattgttgtccagactgcttcctttaggatattcttcatctttaatgccatagctctgttcacatcattggcggtggtcgtggttcaaataacagttgtcaggggagaaaccaagtctgagcgaaaggttgttgaggtgatcaacaagcttatgtggctggcatcagtttgcacaaccatttctttcattgcctcatgctatattgtgctaggccgccatttccaatgggcagcaatactggttagtttgataggtggtgttacaatgactggtgttcttggaacaatgacgtactttgtggtgaaatcaaagcgcatgaggaagattagaaaaaaagagaagatgtcaagaagaagcggctcaagctcctgggttgataatacggaaatctcagagactgagcttaatcaagtgtatgccttgtaaagaggcagggtctttgaactcagcctcgcctctgcaattgagaatgtacatgcttaatcaagtgtatgccttgtaagacacagggtgtttgaactcagcctcatatctggaatcgagaatgtacatgaaaattccagatgcgtgcattaacaaatagattactcacattattccttcattgtacaattcctttctgcaatgacaaacgatgca

SEQ ID NO: 1035 - DNA, 1400 bp, Triticum aestivum
cgctccatgacctctatgagcaacagggtcagtccccgtggtacgacaacctctgccggcctgtcaccgatttgctgccctacatcgggaacggtgtccgtggagtcaccagcaacccaacgattttccagaaagccatctcttcatcaaacgcgtatgacggtcagttcaaggagcttatatcggctgggaaggatgcagagagcgcttactgggaactcgtcataaaggacatccaagacgcgtgcaagctgtttgagcccatctacgacgagactgatggggctgatggttacgtttcagtggaggtgtctcctaggctggcaaatgacacccaaggaaccgtcgaagctgcgaagtggttacacaaagtggtcaaccgccccaatgtgtacataaagatcccagctacagcagaatgtgttccttctatcaaggaagtcattgctaatggcatcagcgtcaatgtcactcttatcttctctgttgcaagatacgaggctgtgattgatgcttacctcgacgggcttgaggcttctggtttgagcgacttatcccgagtaaccagtgtagcatccttctttgtcagccgagttgacagtctgatcgacaaaatgcttgagaagattggaacaccggaagctcttgccctgaggggaaaggctgccgtagcacaagcaaagatagcaaatcagctttacctgaagaaattctctggcccgaggtgggaggctttggtgaagaagggagccaagaagcagaggttgttgtgggcatccaccagcgtgaagaacccggcttacttggacactctttacgtcgatcctctcatcggacctgacaccgtctctacgatgcccgaccaagctctggacgcgttcatcgaccacggcacagttgctaggacaatcgacgcgaacgtatcagaagctgagggcatatacagtgccctggagaagctgggcatcgactgggaagaggttggcaagcagctggagcacgagggcgtgagctccttcaaggggagcttcgacagcctgctcacgagcttggaggagaagggcaatgccctcaagaccgccgccaacctgtaggcgctaaaattgttggatagaatggtttggtaccggcgctggccatcaaacgattacccaataaaaatgccagcttgctggctctccccttccattcggaaatgaaatgctcccagttatctgggtgagcttctttgtattctaggcgtgcctggctgtcattgtgtaactgaggtttgttgctcgcaactgctatcgttttctgatcaattgtttttgagcaagtgagccatatttgtgtatctttgggaaatgcatttctccttactgttgttatctgtatgttcgcaagattacaggaatgtt

SEQ ID NO: 1036 - DNA, 1237 bp, Triticum aestivum
ggaggctgtgaaagcatatggaatccaccttggtactgagatgtgcaagaaaattttggctagtgggatcaagactttgcacctgtacacactaaacatggagaagactgctttagcaattctgatgaatcttggcttaatagaggagtccaagctttcaagaacattaccttggaggccaccaactaatgttttccgtgtcaaagaggatgttcgccctatattctgggccaacagaccaaagagttacatttcaaggaccactggttgggatcaatacccacatggacggtggggtgattccaggaacccatcatacggtgcacttaatgatcaccagttcacacggccacgtggacgtggtaagaagctccaagaggaatgggctgttccactgaaatctgtgcaagacattaatgagcggttcgtgaacttctgtgaaggaaaacttaaaagcagcccatggtctgagttagatggtcttcaacccgagacgacgataattgacgatcagctggtgaagattaactcaaagggtttccttaccatcaacagccaacctgctgtaaatgcagagaaatctgagtctcctagtgttggatggggcggcccaggaggctatgtttaccagaaggcctacgtcgaattcttctgcgctaaggagaagctgggccaactcatcgagaagagcaaggcattcccttccctcacgtacatcgccgtgaacaaggaaggggaatcgatctcaaacatccctgcgaacgccgtgaatgctgtcacatggggtgtgttccccggcaaggagatcatccagcctaccgtcgttgactcagcgagcttcatggtctggaaagatgaagcgtttgagatctggtccaggggatgggcctgcctgttcccagagggcgactcgtccagggagttgctagagcagattcagaagagctattacttggtcagcctcgtggacaatgactacatcagcggggacctctttgctgcattcaaggagatctaatttcgatgagaccttacagtatgctgcgtttgaccgcccttcgctagagtcctgtaatatgatttgtcgtgatttctgtcgatttatccaaaccactctatgaataagaattttctatctgtgttccttcgtgtgcagtctctccacttgtctagcttatttgttacctaggtttattttacccaatgatgagttgaagcctttttaatgtatatacgt

SEQ ID NO: 1037 - DNA, 588 bp, Triticum aestivum
gtaacattgaggaaatcgacattgatcatgcagatgacctggaaagtgcccctcaccaggtgacaaccaacctgaatttggtggagtctgccatttgaacttcacttctggtcctgccaaggggaaattttgctgggaacgacagccggaatggagcgcattcagggaaagcagtctcggccacggtattttagaggttgtgaattcgacatatgccttgtggacatggcaccggaaccaggatgcatacggagaacacagtgtgggagatcagatctatatagtacgggaacccgataagtgcctattgcagccgaggggtgtgatttcgcaagactgtcccacggcgggatgcccttcttcaacattaagtagcacctcaggtgctgaacaagctgctaaaaatggccgtctccttttggactactacatgtatgattttgattagtatagttttgtagtcccattcttagccttgactaggcgatgcctttgaagcaccaggcaaaatacatgggtagtctggtggcagagttgacagattatattctcattgtagcaagtggggttgtacatgaacaataaact

SEQ ID NO: 1038 - DNA, 1158 bp, Triticum aestivum
tacagtaccgcttcaaccacaatccaagagtaccacagtgtccctcaaaagccacctacaagttcgttaatatatggcaaagactgtgatggattgctggcctacttgggaagatatgtgagaagcaaggcataccttatgaatatggtaaagggcgcctgcaagagcgctctcagctcttgcaggacattagaaacgtgaagccgactcatgttttcaatgctgctggtgtcactggaaggccaaatgttgactggtgtgagacccacaaacaggacactatccgcaccaatgttgtaggcaccttgaatcttgctgatgtttgtcgtgagcaggggttgctcatgattaattatgctacaggttgcatatttgagtataatgctgaacaccctgaagggtctggaattggtcttaaagaggaggacacacccaactttataggttcattttattccaaaaccaaagccatggtggaagagttattgaaggactatgataatgtctgtactcttagagtcaggatgcccatatcatcagacctgagcaatcctcgtaacttcatcacaaaaatagcccgctatgacaaggtggtgaacattcccaacagtatgacaattttggatgaattgttgcctatctctgttgagatggcgaagcgggattgtaggggcatatggaatttcaccaacccgggggttgtcagtcacaacgagattctggagatgtacaaggaatacatcaacccagacttcaagtggaccaacttcactctcgaagagcaggccaaggttatagttgcacccagaagcaacaacgaaatggacgcgtcaaagctgaagtccgagttccctgagctactgtccattaaggaatctttgatcaagaatgtctttgagccaaacaggaaggtttctactaattgaagattcatgtgacacaggtctgctagaagctatttccaattagctaatatatttcatggtggcagctgtggtcaattccattgtggtatagcaggcatacatatttacgattttttgttacgcattacgtttcacttgagaacagatcttaaaatctatgtagtggtggatatgtttgttggcctggttatctatgtgaacagatcttaaaatcttgtttctatttatcagg

SEQ ID NO: 1039 - DNA, 639 bp, Triticum aestivum
acgtgcaagacttgtaaactgagatggagggagtagatgacaaaggtagggactaaattaaggggtgacttcttgtaagaataagtccatttcaacacctcaactcttgcccgactctggaataaaccctcaacccataaaccaggtacttcagactcatttctgccaaaacaagatccaaagtagggacttgttttgaaggtttaagggtgtcaagtgtacggttctaccgctttaaaacatgtatttcccgcactgaacattaacacagttgccatgtcatttggagaaggtatggagagaggctaccttgtgtggatatcttcgtatgcaccgcagatccacactcagagccaccaagtcttgtcatctccaccgtcctatcgctcatggcatacaattacccagctgaaaaaattagtgtgtacctttctgacgacggaggttcgattctcactttctatgctctgtgggaggcctccttatttgcaaagcattggataccattctgcaagagatataacattgagccaaggtcaccagccgcttacttctcagagtcagatgggcatcaagatttgtgcagcccaaaggaatggtcacttatcagggagatgtatgaagatatgactgagcgaa

SEQ ID NO: 1040 - DNA, 705 bp, Triticum aestivum
ccgccgtcctcgttcaccccctccctctcgatctcctcccacctcacctcctcctcgcctcttgccgacgtttcgtcaaggttccggcggcgatggcggcgaggctcgcgcagctgcggaccaaggcggcgcaggcggcggaattcgcctcgaagcacggcggcgcctactacaaggaggcgatggagaagaacaagcagtacgtcgtgcagcctccctccgtggagaagtgccaggagctctccaagcagctcttctacacgcgcctcgcgagtctaccaggccgctatgaagcattgtggaaggaggttgacggtgtcaagcagctttggaagaacaggaaggagctcaaggtggaggaccttggaattgcaacactgtttggggttgagctttatgcatggttctgcgtaggcgagattgcaggcagaggattcaccttaaccggctataaggtctgaattagatgtcgaggcgcgccttataatatactcttagctgatgcttgtcgaaattacctgtcttggttcacaattttgtttctgaaaagtttccagtgctgaatgccagcaagacgagcacacaattgcaacagtgcctcaataatttgctcgctcaattgcccattatttttttgtggtctgtaacttgttccacttgacgcctgctgcaccactcttgtgttgtctggtatgaaatgaaccc

SEQ ID NO: 1041 - DNA, 889 bp, Triticum aestivum
acagtacccagagccgtggtgcatgccccgtctcttcactgccggcattgctcatttggacgagggttactacgctagcaaaggaatcaatatcgtgaagggtactgtggccagtggttttgatgctgatgccaatggagatgttagtgtggtgaagctgaaggatggaagagtactggatgcggacattgtcatcgtcggagtcggtggcaggccgctgacaggcctcttcaaaggccaagttgaagaggagaagggtggactcaagactgacacattcttcgaaacaagcgtcgctggtgtatatgccatcggtgatgtggcgactttccccatgaagctgtacgacgagccgaggagagtggagcacgtcgaccatgctcggaaatcagccgagcaggcagtaaaggcgatcaaggccaaggagtccggcgagtccgtggcggagtacgactacctgccctacttctactcgaggtcgttcgacgtcgcgtggcagttctacggcgacaacgttggcgagacggtgctgttcggggacaacgacccagcggcgcctaagcccaagttcggcacctactgggtcaaggacggcaaggtcatcggtgtgttcctagagggtggctccgccgacgagaatcaggccatcgccaaggtcgccagggcccagccgccggtggccgacgtggaggcgctcggcaaggaaggccttgatttcgccaccaagatctgaagattcctcttatctattctacgcgtgtaaattttgtgtttgtccctcccctgccgatgcttcctagttcctagttcagaagtgtgattcgatttttcattggagtttgatggtgttgctgtgaccactatggcagaatccgaataaatttagtag

SEQ ID NO: 1042 - DNA, 1028 bp, Triticum aestivum
gccctacgagaagctttctaccgtcagaatctgccaaatgtgaccaatttgcttgctactgtcctggtctttctcatagttatctatttccaaggcttccgtgttgtgcttccagtgaggtcaaagaatgctcgtgggcagcaaggctcatacccaattaagctgttctacacttcgaacatgcccatcattctgcactctgccctgattaccaacctgtatttcatatcccagcttctctacaggaagtacagtggaaactttctggttaaccttctcggtatatggaaagaatctgaatattctggccattctatccctgttggtggtcttgcttactatgtaactgcaccatcaagtatggctgatattctggcgaatccattccatgcattgttctatgtggtcttcatgctgtcagcatgtgctctcttctcaaaaacatggattgaagtctctggttcatcagccaaggatgttgctaagcagctgaaggaacaacaaatggtgatgccaggccatcgtgagtcaaacctgcagaaggaactgaacagatacatccctactgccgcagcatttggtggagtgtgcatcggcgcattgactgttcttgctgattttatgggcgcaattggttcaggaaccggtattctgttggccgtcaccatcatataccagtactttgagaccttcgagaaggagagggcgacagagcttggtttcttcgggttttgattgatacatgatagcattgggagcatgttatggctacagcacagcttgagtctttctagacagtcgcaatactgcttggctggctggctgttgtggttgtaaccggagattaaattctgtttaggttaccccgacttatttacagttgagaaatctgtagatgctgcgtgtgttcttcaggccagttatggtggtggaccggtccaaacacgggcgtggccgtcacctgtcatcttccgtagacttctcatgtttttgactatatagcaactgaatgttttgggaccatttag

SEQ ID NO: 1043 - DNA, 683 bp, Triticum aestivum
gctcggagagctgtcctttgagctgaccacggccgggcttgactttgggtttctgatcatgagcgactcgttcttggttgacacattttacagtttcccaagcttgagtcgaccacacagcacgttgaagtacactttcaggaaactgttgggccttaagaaccagaaggatcagcatttttctgatctcatcgttgagcagaaggagacgctgaagaatcgtgctgatcacctgatcaagacacttgagagctgtggctgggacgccgcgggctgccatggaggcatctcgatgctggcgaagccaaccgcctacattggcaaatcgctcaaggtggacggcttcgagggcaagctcgacggccacaacatcagggaagccctcctgaggtccactgggctgtgcataagcagcagcgcctggaccggggtgccagactactgccggttcagcttcgctttggagagtagcgagttcgaccgggcgatggagtgcatcgcccggttcagggagctggtcctgggaggcagtcctcaggtgaatggtagcaactaggattgttggggtgggtcaaatgggtgaagaaaaactgtaaaacctgaagagatgagatgtaaccaactcttatctttctttacctgtttgaaatactttgtttcaaatcgaaatggcactaaaaaca

SEQ ID NO: 1044 - DNA, 706 bp, Triticum aestivum
cattgttagcttcagagacttgttaccgcacgaacgatttcctctaaggagaacatgcttcggaccaggaggcctcttggggaaggtttacaaagggaatgctagaaagatgattacagaagttgctatcaaaaggctcagtaagagctcaggacaaggagtagaagaattcagaaatgaagttgttctaattgccaagttgcagcacagaaaccttgttagacttattgcattcatggagatgaaaggcttctgatttacgaatacttaccaacaaagcttggatatcttcatttttgatgatgcaagtaagtatgttcttgactggccaacaaggtctcaaataatcaaaggagtagccagaggacttctttatctccaccaagattcaaggttgactataattcatagagatctcaaatcaagcaacatcttgttagatgtggatatgagcccaagatatctgattttgcggttacatgtctcctgaatatgcaatggacggcgccttcgccttctctgtcaagtccgatacctatagctttggtgtcctactcttggagatcataagtggtctgaagattagcttaccccacctctcagactttccaacctattagcttatgcatggaacttatggaatgatggaaagccatggatatggtggactcttccattgttgataattgttcaccactgaagttct

SEQ ID NO: 1045 - DNA, 635 bp, Triticum aestivum
tgtgacatcacatgggtgcgaagacttcgtcttcttgagaggcttccatatctcattgtgatgggatgctcgaaattgttgaagacgatcatgcttcagatgaacaagatcatggtatggtagaaacttcacgcaatgacacagggcagagtgacttcccaaagttgagattgatcgtattgacaggacttaagaagctgagatgtatttgtaaaccacagagaattcccatgccttgagacccttcgggtggaggattgccccaatctgagaagcatcccgctgagcttcacacataactatgggaaactgaagcagatatgtggttcagttgattggtgggagaaactgcagtgggaaaatagggaggaggtggcatgtctggacagcaagtacttcattccatctgacagaaccccaatttcaatggcttttgtatggcatgcaggtggcttacttctgtctttagtcttcacacaaataagaggtctcctcttaaattgtttaaaatttgtatatgtgacaggcatagcttctgtacattgttagtattgtattcatgtatacatatgatatactctgtaatttgctggtattgcatttgtgtaatatgaattgttcactttaaatcaaga

SEQ ID NO: 1046 - DNA, 622 bp, Triticum aestivum
tgacgggttgtcatgacggatgatctcacgctcatcgacttggggccaatcgaatacttcgatttgtggccgagccactgaggcgatgtgcggagggcataccggtcctgcttcggcttcatcaacgggtcgagctccccaagcttcttggcctgcttcatgtatgagcttccctccaagatgtgctccatgattgcagccgcttctatctgtccagggtggtgcttcagcttgtgggtcaagtggtcagtgaactccggcttgccgttcatcacctcgcagaacacggcagacaagacctcggcaaggacggaaagaacattggcctcaaagagcacggtcgatgcaagaccagagcccacagccgtgccgttcaccatggcaaggccttccttgggctgcagctcaaagaacccgtgctcgatcccggcgatcttgaatgcctcggcagcggtcaccttgctgccatcaggggccaccgcaacagagttctgtcggccggtgataaggccggcaatgtaggacagcggcacaaggtcaccggacgcggtgatcgtgccacggagcggcaggcacggcgtgacattggcattgagcagcttggtgatggcttcgaggatct

SEQ ID NO: 1047 - DNA, 606 bp, Triticum aestivum
acgacgacgacgcgacgacctcttcttcgaccagacccataacctcctcgtcgatcccccgcagccgcccgccgctctcaagactgatgcggtgctcaaggcgctgagcctggtgtctcccaagggcgcgacgcgccgcgggggctccgggagaagccccggcactccgagaagcccaccaagtacgccggcagcccgaggagcggcggcgctccccgcgtcatccaccagcctcgctaggctgcgatggctaggatggcaaaaactaaaggatgtagcaaaagcattgcgtctttgcgccgcggtgttttgctttgcttccttcctcccggctgctgctgctggtgtggtctactcaaagtctgggtttgtccctagagtttatctaggaatttagttgtgtccttttgtatagtataaaccaaaatgaccctaaaaaaagtatgaacaaaatgcaacctttgttcagtgttgccttgtaagtttaatgttcatctagagttcgtctaggaaaattccaaaaagaagaagtggaagaagaatgtagtagtgtgcactcctgttaatgttctgatgatgtgcatagcaagcagcctaatgttgaat

SEQ ID NO: 1048 - DNA, 587 bp, Triticum aestivum
accgcaccgggcgccccgtttcctgccgacgtgtacccctacttcgcttacataggacgaccgtggccgagaacatcaggctcaactatgcgacgttgcagccgggcaccacggtgagggacaacggcaacgggctgaactacaccagcctcttcgacgcgatggtcgactccatctacggccgcgctggagaagccggcacgccgaacgtcagagtggtggtgtcggagagcgggtggccgtcggcgggtgggttcggggcatcggtggacaacgcgcggagctacaaccagggcctcattgaccacatccgcaacggcacgccgaaacggtcaggggcaatcgagacgtacatattcgccatgttcaacgagaacaagaagccaggggatgaggtcgagaggaacttcgggctcttcttccccaacaagcaacctgtctacccgaccaccttccccaattaataagccgaaagtcaacgtctatgtacgtagctggcctgtcatgcatccatgcgttgccacttgttgaataaaaatagatgcgtgcttgtgacaatgtagcctatgaacgaatcttccttgaga

SEQ ID NO: 1049 - DNA, 581 bp, Triticum aestivum
  misc_feature (547)..(547): n = any nucleotide
gcgcgtcctacgtcggcacgtccgcctacatgtccccggagcggttcgacccggaggcctactccggggactacgacccgtacgcggcggacgtgtggagcctcgggatggcgatcctggagctgtacctgggccacttcccgctcctccccggcggggcagcgcccggactgggccgcgctcatgtgcgccatctgcttcggcgaggcgcccgaggcccccgccgcggcgtcggacgagttccgcgacttcgtggcccgctgcctggagaagaaggccgggcggcgcgcgtccgtggcggagctgctccagcacccgttcatcgcggagcgcgacgcggaggaggcgcagcgctgcctcgccgcgctcgtggcggaggcggcggagctgggcgaccagtagcctagccaaaccgcccgccggttaattagtagtcggagagttaggagtccatccatccaagctgatgtgtacataatccgcgccacggggaggaataaacctgtcccatgtggcgtttttcttttcacctttttgccgtacccantgattattccttcgttgtttcacgtgaatttgca

SEQ ID NO: 1050 - DNA, 580 bp, Triticum aestivum
  misc_feature (119)..(119): n = any nucleotide
agcacgcgctccgagcgacagcacgcacgaccccgtcaccctcagaccccgcagcactacttcatctcggcatcgccgccctgcagcacggcatgaagctcgtcgtggatttgcccgcnctctccagccccagccccaaaagccccgtccaccacaccgacgactccatctacgacaccagcgacaccggtgtccctggcacaagctccggtctgacgcccacaaccccagcaacggtgctcgcgccgcccgccaagcagtccgccggtgcagctgggctcagggccgggtcatgggctatgctgggcctggcaggacttgccgccgtgcaactgggcctcttctagggccaaggccagggtggaggcagtgctgttaggttgcatgtcatttagacatcgacacacaccgtgtcaagtgtttgttcaggaagtgagttgaggtttcttttcacagagggaactggtgcttttgttgtggtgagctggcagtagttggatgctgtgtttgaattgacttcctgttaatttgttgtcctatctatgtcatggatttttagcctcacctgtgtatgttggga

SEQ ID NO: 1051 - DNA, 573 bp, Triticum aestivum
ctcagcgccccgtggcccaccgcggcggtgacctggacacggttctggcctgatggcggcgcggcggcccgcccgtcgtggggttcgaggaggcgtccgcgctgttcgaggaggaggaggccaccctgggggaggccgcggcggcgttccgcgtcttcgaccgcaacggcgacggcttcatcgacgccggcgagctcgggagcgtgctcgcctcgctcgggttcgccgccggcgccggccacgccgagtgccagcgcatgatcgacgcctacgacgcggacaaggacggcagggtcgatttccgcgagttcctcaagttcatggagacggctgcggcctagggaatccacaggattcccatggcgtcacttctctgcaaattctttgttctttcgttctatttttctctttaatcgacttcgatcgctcagccgaatgaagaacggcagcatgtgtatgcttatgatcagtttaggtgctgtttggatcatggcattacaagagccagaaacgggttgtgttttacttgaacagaaatcgatggaaatcgaattgaaatgacatttccgtgct

SEQ ID NO: 1052 - DNA, 573 bp, Triticum aestivum
gagcagttctatagtgacaagagaccagatattattttcaagtggattggcctcatggttagtgactgtggcattgttaatgtaaatattcccacaaatggtgctgaaattggtggagcttttgtggagaaaaagctactggtggtggacgagaagcagggagtgattcgtggaagcagtacatgaggaggaccacttgtacgatcaactatggaagcgagctgcctctagcacaaggaataaattttggctagttcggtggtcaagatcggctgatgaacatgttaagcttcatcgacagacttcaggaatttctactggcgtcaactgaaaaccgaaacttcaacgcagcagcattgctatgtgtgcatataataagagatgagtccaatattaatgcatgtactgctcttgctatgattagccgtcggagttcgagtccaataaacagggaaaaattgcgtattccctgatcggttgatatgtaccaacatttctgatgtaatctttagaacggtatcggttgaaaacttgaaatgaacgataaacgcggtaagaatacaaatggtgtgc

SEQ ID NO: 1053 - DNA, 573 bp, Triticum aestivum
tctactcccgcctccccatgcagggccagagcaacaccgtcacgtcgcaggccgcaccaacccggaggcagaacaccggcacctccatccagggctgcaccctcctcccgtccccggagctcgcggccaacgccgcctttgacacgcgcaccttcctcggccggccgtggaagaactactcgcgcaccgtggtcatggagtcgtacatcggcgggctcgtcgacgccaccgggtggatgccgtggtccggggacttcgcgctcgacacgctctactacgccgagtacataactctggtccgggtgccgacaccggccgtcgggtcagctggccgggctaccacgtgctaggcgacggcgccgatgccggcaactttaccgtcgacaacatggtgctcgggggcaactggctgccgcagaccggcgtgccgttcaccagcggattgaagtattgatccgtcaacttatcatatatgctttgaacggtagacatatatttaccgtaggtaaatcacctactgtttgtcctaaaaaactatacatacatattgatgatgtggtctgactacttcgg

SEQ ID NO: 1054 - DNA, 556 bp, Triticum aestivum
  misc_feature (317)..(317): n = any nucleotide
  misc_feature (353)..(353): n = any nucleotide
acataacatatgggaaacatggagaagtgacagaggaagaagtcacggctgtggccaagcacaaatgctcatgagttcatatcaagcttgccacagggatacacactctggttggcgagaaaggagtgcaactatctggtggacagaagcagagggtagctatcgcaaagggccattataaaggacccgaagatactactacttgatgaggcaccagtgccctggatgcggaatcggagcgcatcgttcagatgcattggatcgagtcatggtgagcaggaccaccatagtggtggctcaccgcctctccacatcanaggggctgatatgattgcagtcctcaaggaaggcanaattgcagaaaagggaaagcatgaggccctgatgggaatcaggatggggtctacgcttcactagtagaacttcgctcaaattcctgagtagaattgtgtattgtttgacttttttctttcttttttactgcatttgtctgttcctagtacattatttggccatgcaatacatttgtgatttgagaagtgaatgcagaggttag

SEQ ID NO: 1055 - DNA, 548 bp, Triticum aestivum
tctttatctccaccaagattcaagccgaccataattcacagagatctcaaagccggaaatgttttgctagatgcacagatgaagcccaagatggcagattttggtatggcgaggatcttcggtgataaccaggaaaacgcaaacacccaacatgtcgtcggaacatagtgagcaactgtttgaaccgatagcttcaattgatctgcaattatatccaaccccatttcaaataactcttgcaagtcaaacaatcaagcagtggctacatggctcccgagtacgcaatggaaggcgtcatctctaccaagtccgacatctatagttttggcgtgttgctattggagattgtaaccggatgaagagaagctccagtagtcacaccacgggctttcctagcctcctagcttacgtacgtacaacatgttttcaagctcccaactctctaaaaagttgcccgatatttttaaaagaaaacagtcatgtaacacaaaagagatgatgtttttgtttgttccagtcatggaatatgtggaaggacgggaaggcag

SEQ ID NO: 1056 - DNA, 542 bp, Triticum aestivum
gacgagtgagacctgcgcgggccgcacacagacgtggtccaggcgcgctgcacgtgggcgcccgggagcggctggagagcctgatgctgtcgcgccgcaccgtgtcggacgtggcgtccctgatgccctccgccggcagggaccgtcttcggcggcggcggcccggtcgtcgtccgtggagccggcgcggacggcgccgtgcggctccggatgcggctgcccaaggcggaggtggcgcggctgatgaaggagagcaaggaccccgcggagccgccgagccggatcatgcagctctgcgtcgccagggaccaggggggcgacgccgctgtgccggccagcccgccgcgctgccggtctccgcgctgtgcaccacaagacggccatgaagaaagagaagcggacgaggttcatggccgtgccggacgagatcatcggatgacgaagcgggacggggtgcttcatggcattcttgtctctctgctctgtgctttttttggcggaattgctgggtttggagcgtgagaagctgccgggacatgttg

SEQ ID NO: 1057 - DNA, 520 bp, Triticum aestivum
cgcgggtgtgggaagcacatacaagacccgggtggcggtgtgcgacgccgcaagtcatgtcctaaagtcggatgtgctcgaggcagaaagcaaggtggggaagctcaagtcacactcgacggagacgaagcttgaggccaccggcgatggctcctgtgtggccaagctcaaggtggagtacgagctcgaggacggcagctcactgtcgccggagaaggagaaggacatcgtggatggctactatggcatgctcaagatgatcgaggactacctcgtcgctcaccctgccgaatacgcctaagatgaagaggaatactgcctctatccagtatatcccacctagagtgagtgataattaaataatgagagccgcagaaatgtccaaattctcgtggcgtttgagtccgtgagagtaatttcgtgctttaagtttgtggttgtgtttatgtgcctttctatggtcgtattcagtgttaaagttatcattttgcttcatcaatgggtgaataaagagaggcaa

SEQ ID NO: 1058 - DNA, 432 bp, Triticum aestivum
cacaatcctttgccgccgcagtgcttgaggctgccaccatctgctactccaagagggagtgcactaaaaaagggtgttctgcctgggcctataaaagaaacgcctacgcctgtgaagaagactaagccaaaagcgaaatctgcaaagaaggtcttgaagaagccttcctcagccgcgaagcgcttgcggaagttgcaaaatttctctgcatgaactcttttatgaattgacactgcagtgatcatgctttctgcatggtgtgtcttttcaaccgtgttctattattacttaattcttcacctaggttagtcttatacgctgttgactatgcaacaaatttatatttatggattgtttaatgttgtgttatgtcatagcgcattcatgataatcatgtgggtgatcattctttggaattagcagtagcaattt

SEQ ID NO: 1059 - DNA, 397 bp, Triticum aestivum
aaccagttgttaaaaagcgtctcccaaagaaaattagacaagttcctgaatgctattttctgcctcggcgatctttgccttctgcattggcaatctatggcgctgtgtgtgctgctggagttggcgcagggatgctgcttgagaggacagtgccattgtctgggaaatgggcaaatgatttgattgctacctctgaagagttctccttgctcttgtgttcagctgctaaagctgcatctcagaaataatcctagctatattgattcagattatcttttgattcccagacaaagtaaaactatcctttctaatgtacggcactgccttatatctacattcctgatttcattttgaatgctagcattacagtatggtgtaacaggcagtatcagaaata

SEQ ID NO: 1060 - DNA, 671 bp, Triticum aestivum
cgggaggggactccgcagtacaagttcatcgaggagtgcctctccacggtggaccgcaagcaccagccgtggctcatcttcacggcgcaccgggtgctcggctactcctccaacgcgtggtacgccgccgagggctccttcgaggagcccgagggccgggagagcctgcagaagctgtggcagcggtaccgcgtcgacatggccttcttcggccacgtccacaactacgagcgcacatgcccgctctaccagagccagtgcgtcaccggcgagcggagccactactcgggcaccatgaacggcaccatcttcgtcgtggcgggcggcggcggcagccacctctccagctacaccacggccatccccagatggagcgtcttcagggatcaagactatggcttcgtcaagctcacggccttcaaccactcgtcgcttttgttcgagtacaagaagagcagcgacggcaacgtctacgattccttcaccgtcgatagggactaccgcgacgtgctcagctgtgtgcacgacagctgcttccccaccacactcgctctctgaccgtctagcggcccatcatggcaacgttgctagccggagagtggctaacaaggttggtcctcatgagcttaatctgtggaataaaactggccagctgcaccattaattagttt

SEQ ID NO: 1061 - DNA, 740 bp, Triticum aestivum
agagaggaggcgacgggcgccgctgttcaacgaccccggggcacggcgggtcgtggtgcgcgcccttcaagacgtgcagcgcgtgtacgactacgacatcctgcacgggctcaccgaggaggaggccaacctggtgctgggcggcgaggtggcgctgtggtcggagcagtcggacgccgcggtgctggacggcaggctctggcccagggccgccgccgcggcggagacgctctggtccgggaacaagggcgccagcgggcggaagcgctacgccaacgccacggaccggctcaacgactggaggcaccggatggtggcgcgcggcatccgcgccgagcccctccagccgctctggtgcccgctgcaccccggcatgtgcaacctctcgcagtagccagcagcacgccggcgaagcctggcccctgcttttgctgcctgccgtgccgtggagtggcatggtgggaaggaatgttcacagatcgaactggcacggggaccgagaatttggaacgtggaagcagcagcggctatccgtggatcgacatggtgatgaacatcagcggatgaccaaacaagaaactgcaaaataaacaattttgtgttgctagcttccacctctcgacagtctcgtggttctggcggtaggatcaaagtatcgaagtgatgtgcgtcagtgcgtggttgctgtatttgacactgaacaattcattgcatctaggagtactttccaataacatgag

SEQ ID NO: 1062 - DNA, 876 bp, Triticum aestivum
caccactaaaagtttatctagctagtctcccatcttccacgactcatccctgaactacagtaggcataggacacccttcccatgtcaggtacatggatggcctaatttgtattttggacatgcaaggttccttaatcaatgcatatcatgataaaagtggactgcacttaaccccagtttatttgctattcctacgtatctttttggagaaagtggagtcagagtgatgctgacttggtgacatcccaatctgtcatcaaattagatttgttggaacatgccccagagcttagagatcttggtttggaattatcaggaccatatgatggttaagcagggctttgccacatgtttgacttgctgcgttttgtattgacaacctatcaccataatcctatagtagcttcttgctgcttcttgccctcctttccgacactacacacacaactcgtttataacctctgtttgtatgttgtactttagccttggcttccatggcatatacttctgacaagtggcaaccagtagatttgattatcatcatggatgggctgttttcacatcttaactatcctttgtttgccaatgttttctgcagatgtttgacgatcaagacttgggtttcttcaccaacttcctggggatcttcatctttgtgttggtcatcgcgtaccactttgtgatggcagacccgaagtatgagaactgatcgccttttgtttagcaatgagaccgtattatactcggagcaaatagggaaatgtgtcggttaatggtaacagagtgcttgacagatctttttaagtgcaattatctggcattgtgacttgaatcatgtttaatctgtttggacaagtgaactgtggagatttcaaa

SEQ ID NO: 1063 - DNA, 1202 bp, Triticum aestivum
gctttctcagcaatagcagctgttgaaggcatcaaccagattgttacgggcgacatgatccctctgtccgagcaagagcttgttgactgtgacacttcatacaacgagggatgcaatggaggtctgatggactatgcgtttgagttcatcattaacaatggcggtatcgactctgaggaggactacccctacaaggagagggacaaccgttgcgatgctaacaagaaaaatgcgaaggttgttaccattgatgggtacgaggatgtgcccgtgaacagtgagaagagtctgcagaaggcagttgcaaaccagcccatcagtgttgcgattgaggctggtggcagggcattccagctctacaaatcgggtatcttcactggaacctgtggaacagcacttgaccatggtgtcgccgccgttggttatggtacagagaacggcaaggactactggctcgtcaggaactcctggggtaccgtctggggagaggatggttacatccggatggagcgtaacatcaaggcatccagtggcaaatgtggtattgccgttgagccttcctacccgacgaagacgggcgagaacccccctaaccccggcccaactccaccatctcccgccccaccgtcttccgtctgtgacagctacaacgagtgccccgcgagcacgacctgctgctgcatctacgagtacggcaaggagtgcttcgcctggggctgttgcccactcgagggtgctacctgctgcgatgatcactacagctgctgccctcataactatcccatctgcaacacccagcagggaacctgccttgcggccaaggacagtccactgtcagtgaaggctcagaggcgtaccctggccaagcctatcggtgctttctctgtcattgcaactgacggcaagaaaagtagcgcgtaaacatttgcatcaccacaatcctacagccaacggccatggtggttaacttctgcaaatgatcacctggtgacccacgatagaaggcgcagcatggcaatagctgtgctctcaagtatcttctttatagtagatgctcctgtacataatcctaaaatcgggttcggttgttcacagaaccgccacatttgcttttgcatatgtatatgtaaattcagcacattcccaggcagtttggggctgctattgttatatggaattcatcaagaaacaagataagcaga

SEQ ID NO: 1064 - DNA, 1005 bp, Triticum aestivum
ccgtgcgcccgcttcgagacagcgccccccctttcggttcgagatttcctagggtgcgccttctccgcccaccgccccccgccgccgcacgttgccagctctccggggcggggctcaccgccggttcggtgaggctgccgggggccctgccgtctgcggcagggtcggcggtctgctgcagggccgcggcgaaggggaaggaggtgctcagcggcgtgatgttccagccgttcgaggagctcaagggggagctgtccctcgtgccgcagggcaaggaccagtcgctcgccaggcacaagttcgtcgacgagtgcgaggccgccctcaacgagcagatcaatgtggagtacaatgcctcgtacgcgtatcactccctcttcgcctacttcgaccgcgacaacgttgctctcaagggatttgccaagttcttcaaggaatcaagcgatgaggagagggggcacgccgagaagctcatggagtaccagaacaaacgtggaggcagggtgaggctccagtcaattgtcacacccttaacggagttcgaccatcctgagaaaggcgatgccctgtatgcaatggagttggctctagctcttgaaaagctggtgaatgagaaactgcacaacctgcacagtgtagctacgaggtgcaatgatcctcagctgaccgactttgttgagagcgaattccttcaggagcaggttgacgccatcaagaagatctctgagtatgtgtcgcagctgagaagagtcggcaaaggccacggagtgtggcacttcgatcagatgctgcttgaggaggcagcttgaaggacacgatgactacgggcaatggaggatgtaggtgtgatatgtcaagtagtggacagataagccaaccactggatgtggttctgagggatttttgcagtggggtttgtagggtgctatgctgctgaactgctctgtgtttgggatttgaaataaaacgaagggagatgtgccccgctcttaaatgccagtcttc

SEQ ID NO: 1065 - DNA, 1047 bp, Triticum aestivum
gcatcttggagcatgcattgctgtcatggagagagcagcagaggcacagccagcagaaacctcaggaacttcagatgaacagatcgcggccgacctcaaatacgccaggatgctgcaggagatggaggatctggatgtgaacacgcctcccaacaacgacgaacaagacgatataagctgtgtgccttccccatccgacaccgatgacgatgatgatcgcggcgacgaagaggaggctgctaggcaggatgatgatgacaacgacgacaccgacgacgatgttgatccggacaacatgacatatgaggaaaggcaggaactggtggaatcagtggggaatgagagcagaggtttatctgatgagctcctgtcatacttggtgccatggaagtacaggtcaggatcagggttcttctcaaggaagacaaaccatgatgacacttgtactgtgtgcctgtcagctttcagaaaccgggagaacatcataaccttgccctgcaaacataattaccatgcaagttgcattagcagttggctcaagatcaacaaggtgaagagattaaaaattgcttctattattatcaccttttgccgaaggttagagaaaaagtacatggctttgggcaaaagtaacaagttgctgacatgtgattaactgatggtgaaacagacctgcccagtttgcaagtatgaagtgtttgggccctcctagcatgtcatcagcagccaatcgaagctcacaaggcggcgacgcgtcatcgcgtcatcgcggcgctcgcttgctacgcctactcattcagtacaaaagaaagaaaagataaaaaaaacagaattttagtttgatttcactgtcaaaaggaaggaaaaggcacacaaaaaacagattttttttagtttaagttcaaaagcagatatttagttggatttcactgtcaaaaggaaagaaaaggaaaaaatatagatttttagttttagtttactgtcccaagggtgtctaccccactgtaatttttggcatgtgcaagtgtcctgatggttcagaaactt

SEQ ID NO: 1066 - DNA, 752 bp, Triticum aestivum
aacctaccgccgccgctctccaaggtcccaaggctccagatctccctccttcgcagctgcctcggtggcctttggagcgcacgagatggcggaagaagccccgacaccagttgttgccccagtagaggcacctaccctggttcttggtgagccaatggacttgatgactgctctacagcttgtcatgaagaagtcaagtgctcatgatggccttgtgaaggggctccgtgaggctgccaagtccattgagaagcatgctgctcagctttgtgtgctggctgaggattgtgaccagcctgattacgtgaagctcgttaaggcactatgcgctgagcacaatgttcacctggttactgtgccaagtgctaaaactcttggagagtgggcagggctttgcaagattgactctgagggcaaggcaaggaaggttgtgggctgctcttgcgttgttgtcaaggactacggtgaagaatccgagggccttaacatcgtgcaggagtatgtcaagtctcactagatgagaatgtttcatgatgcacttgtgttgggcattttggtcctcggtttcatttatgctttattcttgggcttcctattgttccaagtttcaagtgtgagcctagcagatatcgtcgatttggacctttgaacctttgtttatctggcagctgctgccttcagcgtaaatcatcaagagctgataatatatttctctttgcaatatcacattttgatgttttgctctgttgctg

SEQ ID NO: 1067 - DNA, 932 bp, Triticum aestivum
gagtaccgcagatgacccacagtcaaataaccattttatggtccaaaccagtgccttccgaagaagttttgcccaaatggagggaggtgatggagcaatatcacagggaagcattgagagtggccaaatcagttgcaaggatcattgctcttgctttgaacctagatgcggacttctttgatagacctgaaatgcttggcgattcgatagccacattaaggctcctgcactatgaaggtggacaaaaaacaggtcaagtgtcgaatccttctaagggagtttatggagctggtgcacattcggattatggcctgatcactctcttagcaactgatgatgtagttggtctccaaatatgcaaggacaggaatgctcagcctcaagtatgggaatatgttgctcctgtgaaaggcggctttattgtcaatcttggtgatatgctcgaacgctggagtaactccattttcaggtccactttacatcgagtggtccttgatggacaagagcgttactctattgcctttttcgtggaaccaagccacgactgcgtagtcgagtgcctgccaacctgcaaatccgagacgaatcctccaaagttccccccaatcacttgctcggcgtacctatctcagcgctacaaggacacacacgcagatctgagcacttacagcgacggcaaagcctgaaagaagaagctctggtttttgccctgtccccctttttttgccttcccatctatctagtatgacgtgtaatgttgcaagtggcaataagaatgcccttaggatggaggatggtaatgttgtactgctaatgtgctaatatcagtgtaaccatagctgtggagatgtcattcattgttcatgtggacatgaacaatggttgccttctttctgaatgtgtacaagttccgaagtttattgctcaccgtg

SEQ ID NO: 1068 - DNA, 874 bp, Triticum aestivum
gggtggaagtatgccagaatctgcttctccatcagaaagctgtagcacaagttcggcgccatggatgactctcccatgatgccaggctcaagacttcccgcacccccatttccatatcctcttgttccgcctgccctctggggttgcttacctagctggccagccgcggcatggtcactccatgggtcgggacctacgggtgcatatcgccgtctgggtcaagcaacagcagctgttcaggcaatgggtctcctactctggggaagcattccagggacccctatccacagaaagatgacaaggaggagaaatcactgtggtttcccaagacactccgcatcgatgatcccgacgaggcagcaaagagttccatatgggcaactcttggcatcaaacctggagacctggcgccttcaagccttttcagttcaagggtgagagcaagggccagccagcagatgcacgccctgcccgtgctttacaggcgaaccccgcagcgttttctcggtcgcagtcattccaggagagctcttaaactgatggctgctgcctatctaatacattttggcaacacagcttgtcctgtagtaaaatttgtacataatagtatagctttgcgatatgggaaaagaccaaaggagagctttttgaatagccactgacctgcagtggagcttgcaaagagctttcatgagaacttacttgagaggtgtgtactgtaaatatttgacaactggttatctataacaatgtaattaggttaagtcaggagtacaatcacctggtttgccactcctattatttcggtgcgggttgtaacatttaacgttgctactgatgaagactatttatagtactatcaataaacagtttg

SEQ ID NO: 1069 - DNA, 780 bp, Triticum aestivum
  misc_feature (773)..(773): n = any nucleotide
tcacaaacatatcaatgactgccgtgagaagaatcgcaagttcgttgaaccattgagctgcagattggtctgaagaactatgacccacaaaaggacaagcgtttcagtggttctgttaagcttcctcacatccctcgcccaaagatgagggtttgcatgcttggtgatgcccagcatgttgaagaggcagggaaaatgggcctagactgtatggatgtggaatcccttaagaagatgaacaaaaacaagaagctggtcaagaagcttgcaaagaagtatcatgctttccttgcatctgaggctatcatcaagcagattccccgacttcttggacctggtcttaacaaggcaggaaagtttccaactttggtgtctcaccaggaatccctcgagtccaaggttaatgagaccaaggccacagtcaagttccagctgaaaaaggtgctttgcatgggtgttgccgttggccacctgggtatggaggagaagcagatcttccagaacgtgcagatgagcgtcaacttcctcgtctctctgttgaagaagaattggcaaaacgtgagatgcttgtacctgaagagcacgatgggaaaggtgtaccggttgttctaggctctagtcttctaggatttccaggagattgacaacttggaacttttgttgctttctcaattatcaaattttcgtgcgcgacgagtgacaattattgtcttgtaccgagatggtttgttctattgtctggaacttgatgacattttatccgttgtccctgnccatcct

SEQ ID NO: 1070 - DNA, 834 bp, Triticum aestivum
actgtgctccttttttagctccagcatcctcatacagtgcgggaatgattccacctcggggaatgtatccatctccagaatggagtgggtaccatcaggttccattaggtccatattaccctcctggaatcgcttttcatcattttccaactcctcctgtgaatcatcctatgtacaggggagcagatgtaccgggacatcaagaactgccctccgatgaatacccagagagacctggccaacctgaatgtcaacattttgttaaaagtgggttttgtaaattcaaggccaagtgtaagtatcaccatccaaggtcacttgtgcctccaccaacagccggagctcttagtccactcggcttgccactcagacctgatcagcccgtgtgcacatactatgaacgctatggagtctgcaagtttgggccagcttgcatgtacaatcacccttttaattttggtcatcctgtatccgcagcagggccacctctctctgctcaatacctcacttcaggaaactacacggtctagcaagcagggccgattttttttctgtggtcgccatgatgcttggaataacacttccacttgtaaaatagcgcagctgaaagttgcagagttttcatgttgacgatggagatctggattgcaagtcagcaacgaagttgcatgaagttgggtgcatagccgccgggattcgtagaaactaaacaggtttcgatacatgacactgctgcccctttatattgtagagcacttgacggttcgtacacaattgttgcgtcactcaagcccaccttttcatctcaactgttctgcgtttacaattttatat

SEQ ID NO: 1071 - DNA, 706 bp, Triticum aestivum
tggaatgaatagattcgtagataggacctcatcccattgatcgctgagacacaggtagagttcttgtttcgtgttttcaggtaattaagctggtatccatttaagtttgaatatttttattgatctagctgctgtttgtgtagcgggttatgatggagcagttggctttctatcaacatcaagacaagcagctgctgacccccacagggacttgagactgaacattgatgaaatgagttatgaggaactgttggccttggaggaatccataggtactgtgaacaccggccttgccgacgaaaagatttcaggttgtgtgaaagaagtggtctgttgcagttctgatgaggagcaagacgaggaagatgatgggcgctgtctagtctgcctggaggagtacaaagacaatgatctcctagggatactgaagtgcaggcacgacttccacaccgactgcatcaagaagtggttgcaagtgaagaacgcatgcccggtatgcaaatccgccgcggcttagggctggagaggaagcagaataaccgatgttcctctccattgattctagattgagattgagttatgcggtccccggtccattctttggtgcctgagccatggaaataagtgcgctaggacgacttgtttcgtgggttgctgtagctgtgttatcatgtcttgctgtaaaaactttcattcaacaagcaat

SEQ ID NO: 1072 - DNA, 728 bp, Triticum aestivum
tggggtgtgagatggatctaccatacctgttttatgatactccacttggaaaggtaggtgccgtcatctgctgggagaacagaatgccacttatcaggacagcgatgtatgccaaaggtgttgaaaatatattgtgctcccactgcggatgcgctgccaagttggcaatcttccatgacacatattgcgcttgaagggggatgctttgttctgacagcaaaccagttctgccgcagaaaagactttcctcccccgcctgagtatacctttggtggccatgaggaggagccatccccagaaaccgctgtttgtcctggagggagcgccatcatttcgccatccgggacagtgttggcaggtcccaactatgaaggcgaggccctcctcacagctgacctggaccttggagaaattgttcgagccaagtttgatttcgacgtcgtgggacactacgcgcgccctgaggtgctgagcttgactgtgaagaccgaaccgaagcacgccgtgtctttcacctctactgtgggataagattcgaggcgcaaagagggacgatagtttgaagacctgatgtccagtagtcttccgtagtcgtgtataacaaagttctcgtccaacgtctttgtcggcattacaacaataattgtggcttcatatatttcttgtaaagattctctactggtttgctgttacactctcactcggtagtcaccggccgccatatatac

SEQ ID NO: 1073 - DNA, 726 bp, Triticum aestivum
gctcatctctgtccactccaaaccctagcctcctcctcctctcgccgctcgccgcgacggccgacgccgccgcagccgccatgtcagggaggaagaagacccgcgagcccaaggaggagaacgtgacgctcggccccgccgtccgcgagggggagcacgtcttcggcgtcgcgcacatcttcgcctccttcaacgacaccttcatccatgtcacggatctgtccgggagggagacgctcgtccgcatcaccggtggcatgaaggtcaaagctgatcgtgatgaatcatccccttatgcagctatgcttgcatctcaggatgttgctgtaagatgcaaggagcttggaattactgctctgcacattaagctccgtgctactggtggaaacaagacaaaaactccaggtcctggtgctcaagctgcgcttagagctcttgcacgttctggcatgaagattggacgtattgaggatgttaccccggtcccaactgacagcacccgccggaagggtggtagaagaggaaggaggctgtaattccatgctcgttcaaggatggaacaataccaagctatcgatatcctgtgtcttgcaacttgttctgtactactccgtttatgatgttaagtcagatcttgtggatttatagattttgagagatattgtgttgcatgtttagaaaatgaccctttcccggctttgaatcaagtggttgccatctattatt

SEQ ID NO: 1074 - DNA, 497 bp, Triticum aestivum
  misc_feature (217)..(217): n = any nucleotide
  misc_feature (253)..(253): n = any nucleotide
gcgtgccgacgtgaacgtggtgaagcaggtgctctccgaccgagcgggcttgtaccccaagaacatcggcaacccgcacatcgcccggctgctcggcaagggactcgtgctcactgacggcgacgactggaagcgccactgcaaggtcgtccaccctgccttcaacatggacaagctcaagatgatgacggtgaccatgtccgactgtgctgggtcnatgatgtcggagtggaaggcaaagatggacaaggcnggcagcgtggagattgatctgggccaccagtttgaggagctaaccgcggatgtcatctcacacggcattcggtagcagctacgaacagggaaaaaaggtcttcctcgcgcagagggagctccagtttcttgcctactccaccgtattcaacattcaaatcccagcattcaggtaccttccaactgaaaagaacctcaagatatggaagcttgacaggaggtgaggagcatgctcatgaacatca

SEQ ID NO: 1075 - DNA, 623 bp, Triticum aestivum
aggtgtgggaaagaataatggacgcggatgggggcagaactagagatcctgattgggcttagttcacagatatgtaaagtgaatcctaaagacttcacccgtgaactggacaatggtcagattaagcagagatttctgaagaggcttatcgacacactgaatgaaaatatgaaacctagcagtcattgtcctgggatcaggaggatgatagttgagcaaatcatacacttgatggagtgcaattctagttatgcagattgcttgagtgaattcaggatgacggaagcattatcaatggtagaacaaacactgtcagaggctgaggactacaggctcttcttgggtgatgaaggatttatgaagtacaacgtgcctttatccaattttgtcgccatagcaaagaaaatgtatgtgttgcgctgtgttatggcccaggcgcaggagaatagggattaagagtttaagacttttatagtagggttttagtcccgtagaaggtttccctactgtatccatgtctattaagagtccaagtctattaagttccttttaaagtttcttacctaccaagtcattgtaaccgtggttatataatgttagggatgattattctgaaaatcaaa

SEQ ID NO: 1076 - DNA, 621 bp, Triticum aestivum
ttatcagagagaagaaaggaaggatttggagggtgaacaactggggactgcgcagacttgcttacaagataaagaaagcaacacatgccaactacatcctaatgaactttgagatacaggcacaatccataaacgagttcaagactctgctagataaggatgaaagaatcattagacaccttgtgatgaaacgagatgaggcgattactgaagattgccctcctccaccagagttccatgcaatgcgatctcaacagttggatgacgagtatattgatgaggaatatgggagggtggacgatggggatgatgaggctgaactagagtcttctggcaatgttgatgatgacgttgaagatggcgatgaacctgaaatcattcttgttgatgaagttgatgatgacaatgccgaagacctcagaagaagaaataggaaggtgaaactggagaagtatacggcggagaaggtcttgaggtagcatgcgtatctactgtatggtttagttcttatacaaaggaacacttgtacgatgaagtaattacattaggtgttttccctgtaccggtgaccactattacgatggtagtaattagtgagataagctcatcaggtcttctccc

SEQ ID NO: 1077 - DNA, 621 bp, Triticum aestivum
gccacctcctcccgcttcctaccaccatcttccccggccaccggcggcggcgacaatggtgcagggacgccagggccagcgcgtcaggctctacgtgcggggcaccatcctgggctacaagaggtccaagtcgaaccagtacgagagcacgtcgctgctgcaggtggagggggtgaacaccaaggaggacgtgtcgtactacgccggcaagcgcatcgcctacgtctacaaggccaagaccaagagcagcggcaccgccgtccgctgcatctggggcaaggtcacgcgcccccacggcaactccggcgtcgtgcgcgcgcagttccgctccaacctccccgccacctccatgagcaagaaggtccgcgtcttcatgtaccccagcagcacctgaaggctatgttgcctattctatttagatctagctggctttgtggatgtctgttatcagtttgatgacaggtttataaccaaagattttgtcggtgattttggaagagtttagttacagactgttagtttcgtctcgtgtaactcaacttggtgacacattttgctctgaaatgaagtatgatgtggctataaactgtttctctggaggatccgtaacatatttgattg

SEQ ID NO: 1078 - DNA, 568 bp, Triticum aestivum
ccggcgagggggtcctccagtacaacctcaccgtggacgtccgcgtccgcaaccccaaccgcttccgcatccactacgagtacgccgaggcgcaggcgtcctacgacggcgagcgcttcgggtaccaccccgtccagcccttctacctggagcggaagggcgagcgcaccgtcacggccgcgttcgccggctcgtcggccgtcgacgaccgcggcgcgctgcgctcgtaccggagggagaggggcgacggcttctactacgtcaaggtgaggctctacgccgacctcgggttcaaggtcagggtttcaacgcgcgccgcaagagcaagatcacctgcacgctccgcctgccggtgcccaacgcgagcgcggcgccggtgccgacgatgctggggacgaggtgcgccgtggacttctgatccgccccggttcgtcacaacgggatttgcttccgccggctgccgtgccaaagattatattttgtttgacgctggtagcatgtgtttgtcattttgaaaccgtacattagggaggggggccgtgcttaaattattcctgtaaacgcgtct

SEQ ID NO: 1079 - DNA, 778 bp, Triticum aestivum
gtcgtcatcatacagtacaccagaagtacaacgaagaagagtcgtcgtgctcgtgcgtaggtgcacttcagccacgcctttgcatccgagatgagtgacaaggggaagcatacatatatggcggcggccatggagcagagcaacgggggcggcggcgtgaaggtcaagttcatcgagacgcagttcgtcagctccgacgccgctacttcaagtcctcgtgcacggctcaaccggcaagtactccagatgccccgccggcgtcctcggtgcacaggcctcgcccgaggccgtgcggcagagccgaccaacaaggcggccgtgcgcctccggcaccgaccagctgacgacggctgcgccggcgaggccaacggtggtggccttcgagccgctgcacgtggaaccggagctgaacgagctctgcgacttcgccgacctgctctacgcgaccccgagcgcgcggcgccacggcggcagcatcgtcaacggctttccttactgatacttggcccgtgaagaatcgtgttacccttctctcttgaggatcacgtatgtgacccttttgctcaaatgctcactgggagcgccagatgtgatcttccgcaaacacaagtggaagtaagaggaaaatacgaaaatgtatgaatatattgtgttcagcgaaaaggtagaagaaagagatgggcatgtatgctggcaaacgagcgaagtgtgtcgtcttcctgtcgggttacatgggcaactgtaaaatgttcaattgggtcatctgtagtagaattag

SEQ ID NO: 1080 - DNA, 661 bp, Triticum aestivum
cacccccgacccgagcgcgcctttcgcgccagggagtgtactggaagcccaccggcgccgacaagcccgtcgcgccgcgggggcgcacgcttgggatcaagaaggcgctcgtgttctacgccggcaggcgccgcgaggggtcaagactgattggatcatgcatgagtaccggctcgccgatgctggccgcgccgccgcgggcgccaagaaagaatcgatggacgacgccaccgcggccgccagccgccgccgccaccatccccaggaacaacagcagcctgttcgtggacctgagctacgacgatatccagggcatgtacagcggcctcgacatgctgccgccgggcgacgacttctactcgtcgctcttcgcgtcgccgcgggtgaaggggacgacgccacgcgccggcgccggcatgggcatggtcccgttctgaggtgacggcgacgcgatcgaacaggtggtgatcgatgctgcaacgtgtgtaaatatacagcgccggctgggtcaagagatggctcgggtgacgcgcgcgcggcgtgtcctggcgttggcgccggggcattctttagtttttcatcttttcatcatctcagatggtagatacaaaacagtgtatgtatgtagctctgtttctctctatagaaccccacaaatttt

SEQ ID NO: 1081 - DNA, 703 bp, Triticum aestivum
cgtctcgttctcttttcttgcttgtttcccaaagaaggagaaggagaagagcggcggcgtctgatctcgtcggcgcggcgatggcggcgattcggcgtctgatcccgtccttcaaccgggtgctggtggagaaggtggtgcagcccaagaagagcgccggcggcatcctcctcccggagacctccaagcagctgaactctggtaaggtcatagctgttggccctggcagccgtgacaaggaagggaagctgatccctgttgctctcaaggaaggtgaccatgtgctcctgcctgagtatggtggtcttgaagtcaagcttgctcctgagaaagagtacctcctctacagagacgatgacattctgggcaccctccacgagtgattcagatggtgcggaagtcatcagcttctttaatgcaggagaggatgttagagtttccatgttatcggataaacctgaagtagaactctcttttatggtgtgatgatagatttttacctcgaacatcatgaacttatatgattgttgccagactttctgtcgtgatgcagttcagtaaacttgcagctgaagtgctgccttaattttcgtcaaattacttccctggctgctaagccttgcgttatttggattattataatagtgggttcattgatgcattggtgccctgttttactctagcgtagaccatgtgtaagtgc

SEQ ID NO: 1082 - DNA, 438 bp, Triticum aestivum
cgtgatcgattccattcctgttgatcatggcgacgttgttcagtttgtcgcaggcgatatgatggattttatcccccaagcagatgccctcctgcttaagtttgtcctacacgactggagtgatgaggactgcgtaaagatattaaaacgatgcaaggaggcaattccttctaaagataaaggagggaaagtcattatcattgatgttgtggttggatcctcctcccaagcaatgtgctatggaacccaactgctgtttgatctaaccatttctatgctaacaccaggcatggagagggatgagaaagagtggttcaagatattcaacgaggccgggttcactgagtacaagattagtcctgtgttaggcattcgatccattatcgaggtctttccataaggcagcaatataggatgggaattgaaatagttcccttg

SEQ ID NO: 1083 - DNA, 673 bp, Triticum aestivum
acgacgaagagccgtggaagtgctgtgacagcattgtccactgcccagaggatcttcccgccgttcttggcgctgcgacgacgagctggagcccggccaagtgcaccgccgcgtgcaagtcgtgcagggaggcgccggggccgttcccgggccgctcatctgcgaggacgtctactggggcgccgacccgggccccttgtgcacgccgcggccatgggggaaatgctgcgacaaggccttctgcaacaagatgaacccgccgacctgccgctgcatggacgaggtgaacaagtgcgccgacgcgtgcaaggattgccagcgcgtggagtcgtcggagccgcctcgctacgtctgcaaggaccgcttcaccggccatcccggccccgtgtgcaaaccccgagcggagaactagctagctacagatgatcgatgatcgatctgtgtgtccatcaataaaactcgccctagcttgcagctagctgatcgttcgttcgatcattcagagttggtatagctagaggctagagcttagctccatccagatttttcagtgctctgcagcttttgtgcatcttgcatgctttgttagtttgtgtgctccatgtgtgtgggtgtgtttaatttgtccctgttcgcttgtgtggaccaagagggaaaatataaatatatatgc

SEQ ID NO: 1084 - DNA, 691 bp, Triticum aestivum
tgaagctcaacgtgtcccggggacgtcgttccctgcgcgagcccgggtgttccgcgtctgccacgccacatggacgacgagaccatgggggtggcgctgagccggatccgggacttcgtgcgccagcaccagcagcagaaggccaaggcccagcgctggccgccaggagccacctccacctcagcctccagcgccacggcgccatggcgtcgcagtaccacgcgctctccagccccatggccgcgctgctgtcgccccagtctccgctcgtccacgccgccagctaagcgaaaccactacggtcggtcaagtgagccgtgcgtacatttgatttggtacgtacgcacttttttcgatcgcatgcatgcgcgcatggggcctggatggatgcatgcgattgtttgggaaggtttagacatgcaaaatgcggcatgtactacgtagctatagcttaacgttttacggaggttgcaatggcgcccgatgtaaggtaagccgtgtgtgaccacgcatggtattacagtcctcttgtttcgtttattatggtttggtttggtctgatcggatcaaggcttctcgatcagatgctgtaataaacttgtactaaggtacctacaatattgatgttgtatatcaccctcaaaagagggtccatgttgtaccacatgccgcatgagtgacgagtttaaac

SEQ ID NO: 1085 - DNA, 680 bp, Triticum aestivum
ggaccgatcagctgaaagtttttcccacacccagagtactggttcttctttcacaggctcatgcctttggcagccacagacatcgaggagaacccgagctgctgcggtagcaaaccattgcaaggaagctaaatggatcattcttcggcgcgaagattgttggaggggtgctgaaagcccatccaaatctacagctctggtgtaagatcctgagaagcaacattggggacctgtcattgttgggtgatggccttgggtacatagcagatttgcagaaaatctgctgccaagtcacgtaaagatgcgccagctgattatatccaagaaaccgctctcctcgacacagcccgagtttgccaggttgcatgatatgcttctgccaagccctgatgcagcagcagcagaccaagaaagctggagtgcggatgttcgaaatgcaaaagtgttgttgtgcaggtcagttatgtcattcttttgcctggactacaacgctcattgcactgtaagtgggcgaaacagttcatcaggatccacacatttcaatcatcgggaaccccgtgttgttggggaactaaaccttatgtataggaattctgtgtgctgatcagtgtttccttatctagtatgtagagatattttgtactgaatcttatattgtctgatgtccagttttgtgctgt

SEQ ID NO: 1086 - DNA, 598 bp, Triticum aestivum
tcaaccgcggcctcctcccggcctctgcttcggcgccggtctggggatcacgctgttcgggatggcctacatgttcgtccacgacggcctggtgcaccgccgcttccccgtgggccccatcgagaacgtgccctacttccggcgagtcgccgccgcgcaccagatccatcacatggacaagttcgacagcgtgccatacgggctcttcctcggccccaaggagctggaggaggtgggagggacggaggagctggagaaggaggtgcagaggaggatcaagaggaggcagagatcagacgccaggcaatgaggattatttatatgccaccgacttaccctttttcttttcttgtttctgataatactcgtactactccatatgccttgcgatgtgcatgcggatttattttctcttcttctgatcgcggattaggatttggtgtcgctagttttagcagcgcacttgtattagaaaatgctgtgctggtagtattatgtctagtgctagtagtagtaccgtggctcttatttttacatctttctgtatcgtgccgctgactgtagcgagacagtactataagtataaagtatatttttt

SEQ ID NO: 1087 - DNA, 792 bp, Triticum aestivum
gcagccgccgccagcagctgcgcaaaggctcgacaaaccctaaccctagctccatagctagcttagcttccttcctctcgatctagctagagccatggcgccgaccaagggcgaggggccggccatcggcatcgacctcggcaccacctactcgtgcgtcggcgtgtggcagcacgaccgggtcgagatcatcgccaacgaccagggcaaccgcaccacgccctcgtacgtcgccttcaccgatctcggagcgcctcatcggcgatgccgccaagaaccaggtcgccatgaaccccagtcaacgccgtcttcgatgcgaagcgtcttatcggcagaaggtttgctgatgctcctgtccagagtgatattaagatgtggccgtacaaggttattcctggcccagcagacaagcctatgattgtagtgcagtacaagggtgaggacaaccagttttcagctgaagaaatttcttccatggtcctcatcaagatgcgtgagatcgccgaggcttacctaggagtaactattaagaatgctgttgtcacccgtgcctgcttacttcaatgattcccagaggcaggcaaccaaggatgccggtgttattgctggtcttaatgtgatgcgtatcatcaaacgagccaacagcagctgcaattgcctatggtcttgacaagaaggctaccagtgtcggtgagaagaatgtgcttatctttgaccttggtggtggcacttttgaatgtctctctccttaccattgaggagggatttttgaggtgaagcaccggctggtac

SEQ ID NO: 1088 - DNA, 861 bp, Triticum aestivum
tgattctgttgtttcttcggtcatggctatggaatggatgctttccagcattgccagttcagctatatcaggcctggctgttgttgctctatacaactttagctttgcgagagaacatattgcgagttaatggaagtgatatccgtccttggtgggtatgccatcactattgtgccatgctgatggctctggtgagcctcacatgggggattaagggacaacctgattgtgcccgcaaacagagaggtgtcgagttgtttctgtgctggctgtgatgcaagtttttgccatgatgttgcagaacagatatcaacgtcaaagactatatactcgaattgctttggggaaggctaaaaggatggacgtcgtgtggggcgagactgctggtgttgaaggccaactattgctgttgtgtcccatcctctttctcttgcaggtctttgagggttatgttggatttttacttcttcggacagctcatagagggatcattcctgagtggcaggttgtggtgtgtgggatcctgcttattgcaatggcaattggcaactttgcaaacacagtggacacattgatggttaagtccagattcaaagcaaagatgaagaagtccaagagcaaacgagatcttgctgcatgcacgtcaccgactcgctcatcgctgacaaattcggcagctggagcttgaaatggagacgctcccatcatatgaacattgcccatattcaatcaggggctatcaaaattgtaaagtattagttttttggccaccagctccttgtgctgacagtctctgtcaaagctcatacccatgtaatcatcaaacgactcggttgcttatggtgtcaggttgagggtaac

SEQ ID NO: 1089 - DNA, 1112 bp, Triticum aestivum
  misc_feature (66)..(87): n = any nucleotide
accgaccgccccccccgtgcgtcgcgtgctgtcgccgacccccgggcccggacaccaccacgcgannnnnnnnnnnnnnnnnnnnnnctttctgggtccttccttcattccattcacccacccaaccaaccacctctgcacgcgcagcccagatctcggccccttcccttcctcggaccaagcaccagcaatggccaccacggcagccgacgccacggccgcggcgcccaaggaccagcccgccaacggttccgagcaggtcacgcgccactccgaggtcggccacaagagcctgctccagagcgacgccctctaaccagtacatcctggagacgagcgtgtacccgcgcgagcacgagtgcatgaaggagctccgcgagatcaccgccaaccacccatggaacctgatgacgacgtcggcggacgagggccagttcctcaacatgctgctcaagctcatcggcgccaagaagaccatggagatcggcgtctacaccggctactccctcctcgccaccgcgctcgccatccccgacgacggcaccatcttggccatggacatcaaccgcgagaactacgagctggggctgccgtgcatcgagaaggccggcgtggcgcacaagatcgacttccgcgagggcccggcgctgccggtgctggacgcgctgctggaggacgaggccaaccacggcaccttcgacttcgtcttcgtggacgccgacaaggacaactacctcaactaccacgagcgcctcatgaagctcgtcaagctcggcggcctcctcggctacgacaacacgctctggaacggctccgtcgtgctccccgccgacgcccccatgcgcaagtacatccgctactaccgcgacttcgtcctcgacctcaacaaggccctcgccgccgaccagcgcgtcgagatctgccagctccccgtcggcgacggcatcaccctctgccgccgcgccaagtgaaccacagaacccgtctccgccgctccgccatagacgccaagaacaagaattaattaattactccccattttgtctttcctgctcgccttctgtactctatatctatcttctgcaattcgtataaagatttctccagacaaa

SEQ ID NO: 1090 - DNA, 712 bp, Triticum aestivum
tccagaactgcctcagacggtgcggaagcccatggacaaccagggcaacatgggaccgcgcacgggcgcacggaccccaacatgcccaccggcatcgtgctccaggggtgcaagatcgtgccggaggacgcgctgttccccgtcaggcagacggtccccagctacctcggacggccgtggaaggaatactcgaggacggtggtcatggagagcaccatcggcgacctcatcaagcccgagggatggtcggagtggatgggtgacctcgggctcaagacgctctactacgccgagtacgccaacaccgggcccggcgccgggacaagcaagagggtgacctggccggggtaccgtgtgatcggacaggccgaggccacgcagttcaccgccggcgtgttcatcgacggcatgagctggctcaagaacaccggcacgcccaacgttatgggcttcatcaaatgatcgagccaccagtttgccggccatttgactccggccgtgtgcatgcatgcatgcatgcgctcgtccggtggatgcttgacgagacacgtggagttttaggaagaaattaaggaaggaaacataaagcaagatctgtttgtatattatttgtacagaagtgcaaaagcagttcaagcaaaagaatttctctgtgtaatgtaattgattagaacatttcaacatggtcctgatgtggcttttcttttccaca

SEQ ID NO: 1091 - DNA, 571 bp, Triticum aestivum
gcccacacgatcggccatccagtgccggtttttcaggacaggatctacaacgagaccaacatcaacaccaccttcgcgacatctctcagggccaactgcccccagtccggcggtgacagcagcctggcgccgctggacacgcagacgcccaacggcttcgacaacgcctactacaccaacctcatgtcccagaaggggctcctgcactcggaccaggtgctgttcaacggcggcggcgccgacaacacggtcaggagcttctcgtccagcgcggcgacgttcaacagcgccttcacaacggccatggtaaacatggggaacatcgcgccaaagacggggacgcaggggcagatcaggctcgtctgctccaaggtcaactcgtaatctccgcgccgacactctgctgctgcgcatgaatgaactgaataaggtctcgggtaccagtaccagaatctacggagtagggtggtgtgtggttacgtatgtgtgttggttcgaaactgtagctgtgcatctacgtccacatgtgtaacatgctaattgtatgtcatgctgcgagatgataacatct

SEQ ID NO: 1092 - DNA, 846 bp, Triticum aestivum
atacgccacaatcttctctaccgagtccctgattggagtgtggtactaccggtggcggtcgaggcagcctccgcacatggacactcgcctctcacatgcggagaccgcccatcctgacgagcttgatgaagagtttgacaccttccctacatctcgcccacctgacatcgtcaggatgcggtatgaccgcctccggagcgttgctgggaggatccagactgttgttggtgatcttgcaacacaaggagaaagactgcagtctctgctgagctggagagacccaagggccaccgcgctgtttgtgaccttctgcttcatcgctgcgatcgtcctgtacgtcacaccattccgtgttgtggtcttccttgcaggcctgtacaccctgaggcacccgaggttccgccacaagatgccgtctgtcccgctgaacttcttcaggaggctgccggcaaggactgatagcatgctgtaaggtgcaaccgtctctctcgctccgtgatctggcgccttccttgtttcggtggctcgatgctgagcatgttctatagctgcaactgagatgatgctggggtcgaagcgcggttgccaaaaaattgaactgaactatgtcgttgtttgtagtcttttcagttgcttgtgtgtctgttttgggacggttttgaacctttcctgttgacgactgaaacgcctgatgtgtgactagttattatgcatgtatgccgcctgaagaaattgtgctatcacccgagcttctgctgtgtcctatcatcttttgcatttgcatctagcagtggtcggcctgcatgagaagattcagtgtgcgcctgggaccctgttaatgatatt

SEQ ID NO: 1093 - DNA, 878 bp, Triticum aestivum
ccgccctccgctccattcgtttcgatctatttcggcttcttcctctccaagctacagccccggccatggcggcgacgatccagtccgtgaaggccgccagatcttcgacagccgcggcaaccccaccgtcgaggttgatgtgtgctgctcagatggaaccttcgccagggccgctgttcccagcggtgcatcaactggtgtttatgaagctttggaactgagggatggtggatctgactacttgggaaagggtgtatccaaggctgttgacaatgtgaactcgattatcgcgccagctttgattggcaaggaccctacagctcaaactgagctcgacaactttatggttcagcagcttgatggaaccaaaaacgaatggggttggtgcaagcagaagcttggtgctaatgcaatcctggctgtgtcactagctatttgcaaagctggagccagcatcaagaagattccgctgtaccagcacattgccaaccttgctggcaacaagcaattggttttgcctgttcctgcattcaatgtcatcaatggtggatcccatgctggaaacaagcttgctatgcaggagttcatgatccttcctactggagctgcctcattcaaggaggcaatgaagatgggcgttgaagtgtaccacaacttgaagtctgttatcaagaagaagtacgggcaagatgccaccaatgttggagatgaaggtggttttgctcctaacattcaggagaacaaggagggtcttgagctcttgaagactgcaattgaaaaggctggatacaccggcaaggttgtcattggaatggatgttgctgcttcagagttctacaatgacaaggacaaaacatatgacctcaacttcaaggaag

SEQ ID NO: 1094 - DNA, 1001 bp, Triticum aestivum
cgcaccacgcgctgctgctggagaactgtggcggcggtgccgcccatggtggcggcgtgctgctccactgcgctcgctccgccgattcgagcacagcggcggctggatccgggcgctcatggaggaggccgagaacgagcgcatgcacctccatgaccttcatggaggtgacgcagccgcgctggtgggagcgcgcgctcgtgctcgccgcgcagggcgtcttcttcaacgccttacttcgtcggctacctcatctcccccaagttcgcgcaccgcttcgtcggctacctcgaggaggaggccgtggagtcttacactgagtacctcaaggacctcgaagccggcttgatcgagaacacgcccgcgccggccatcgccatcgactactggcgcctccccgccgacgccaggctcaaagacgtcgtcaccgccgtgcgcgccgagcgaggcgcatcaccgcgacgccaaccactacgcatcggacatccattaccagggaatgacgctgaatcagacgcctgcgccgctcgggtaccactgatcagctcaatggaccatagatcgatgcctgctcagcccatcgttggtgcgtactactaccactgtcgccgatgtttgtcctgttaattgggattgattgttgcgcgtgcagtctgtttggtgtaaacgatgtatgtgtatgagttcttttatgtcactttgtactccaaacatatgtttacgtaagccggtattgcttgtaaaaatgattttctagactagtaagtgtgcacgtgtaacacacgtattatagagttatgaaatagagagaaaattggatcgtagggaaggggagcattggcataagtttcgagggaggaggatagattattgcggcagccatgcctgcaggtttccttggtatttccctgctagttttagtgactcatttgattatgttagactattgtagaaaagattattgggaacttttttgtgtacatcagtaatcattaattaga

SEQ ID NO: 1095 - DNA, 627 bp, Triticum aestivum
cccctacttctcgtacgtggacaccaaggcccagatcgacatcaactacgcgctcttcacgtcgccgggcaccgtggtgcagacggcgccaacgcgtaccagaacctgttcgacgccctcgtcgacacgttctactccgcgctggagagcgccggcgccgggagcgtcaacgtggtggtgtcggagagcgggtggccgtccgccggcggcacggcggcgaccacggacaacgcgcagacgtacaaccagaacctgatcaaacatgtcggacaggggacgcccaagaggcccagtgccatcgaggcctacgtgttcgccatgttcaacgaggacaagaagggcccggctgagatcgagaagcactttgggctcttcaacccggacaatcgccggcttaccccatcagtttctagaaggcgggacacatctatacgcgtacgtacgtagcaagacaacaagcatttcgttgctcagctaaaataaactactgcgggctttgtacttgaaagaccacaccattttgatgtagaatgcgagcatcatgctttgcatggatggcggaaaaggtcccaattatttggatgacgaaaacgctcaattattcaacggagacaacataagaggcac

SEQ ID NO: 1096 - DNA, 787 bp, Triticum aestivum
accgcgcccgtttattattccccttcgcgcagccgcccccgtgtctcccgtgcgcaccttctcgaagcctcccccatggcggaccagctcaccgacgagcagatcgccgagttcaaggaggccttcagcctcttcgacaaggatggcgacggttgcatcaccaccaaggagcttggaaccgtgatgcggtccctcgggcagaaccccacggaggcggagctgcaggacatgatcaacgaggttgacgcggacggcaacggcaccatcgacttccccgagttcctgaacctgatggcgaggaagatgaaggacacggactcggaggaggagctcaaggaggcgttccgcgtgttcgacaaggaccagaacggcttcatctcggcggcggagctgcgccacgtgatgaccaacctcggggagaagctgacggacgaggaggtggacgagatgatccgggaggcggacgtggacggcgacggccagatcaactacgaggagttcgtcaaggtcatgatggccaagtgaggtggcggcgggacaggggtcttccctcccacgaaataagcttaaaattcaagtggattggaatgccagacagactcgcgtggttgtattttgtgctatgttttttaaggatactgttgcctgttgggtagttggtcgggttatctatcttgtagcggtgtagtcttgggggagcagcatcggaattactacctggtttcttttggttgtggcacttatcttgttcgtcttatcatggaatttaggggcgtcgtgcaaatct

SEQ ID NO: 1097 - DNA, 589 bp, Triticum aestivum
ggcgtggcgtttgggacccgcggccacgtttctccgcccgccccgcggcgccggcgccggccgccctgctcgtgcgccgccgcggccaccggaggtgccaggttccgcggcgccgacgggaagtggtgggcgccgctgctcgggtggtcgggccagcccgactacatcgacgcccagccggcgcccctgccggaggaggagcgggctgctgctggtgctgcgggcgcgaggcggttcggggtgctgacggaggagaaggcgcggcagctgcgggtgcggatgatggagacggagagcttccacgacgccatgtaccactccgccatcgcctcccgcctcgcctccgccgcgcccgacggcgacgccaagccgtagagcgcggagccgagcagctcaggctcagctcgccggccggagccatgggagacgcgctgtctgtgcacagctgtacatacgctttcgtttgttctgtctgtcctgttgaccgttactgtaccccattacgtagtcaagaagaggccggtaatatttaggacagggccccttcagaccctccttcctgaacttgattattccatggagatgggac

SEQ ID NO: 1098 - DNA, 719 bp, Triticum aestivum
gaagcaagcaggagcagcagatgccggcgggtcacggtctgcggtcgcgacgcgcgacctgttcgcgcgcccgttccggaagaagggttacatcccgctcaccacctacctgcgcacctacaaggtcggcgagtacgtcgacgtcaaggtgaacggcgccgtgcacaagggtatgccgcacaagttctaccacggccgcaccggacgcgtgtggaacgtcaccaagcgcgccatcggcgttgagatcaacaagcaggttggaaaccgcattatcaggaaaaggatccatgtccgtgttgagcatgtgcagccatccaggtgtgctgaggagttccgcctgaggaaagtgaagaacgaccagctcaaggcggaagccaaggcgcgcggtgaggtcatcagcaccaagaggcagccgctcggccctaaacctgggttcatggtcgagggtaccacaattgagactgtcactcccattccctacgatgtggtcaatgatctcaagggtggttactagggtgtttgggttatctgcctgcacaaccagttcaaatctatggtgctcttatgagtaggatttgctctctgaactgtagtctgggttgggtctttattcatgtcaagaagatattcggtgtaggttgctatcatgagttttgcagaaatgctatactgtgctatttccttcagaatgatggtgtgctctgttgaactatatagtt

SEQ ID NO: 1099 - DNA, 768 bp, Triticum aestivum
ggattctcgtcaagagagatgagcttacccttgagggtatcaagcagttctatgtcaatgtggagaaggaagagtggaagctggatacactctgtgacctgtatgagaccttggcaattacccagagtgtcatctttgtgaacacccgccgcaaggtggactggctcaccgacaagatgaggggaagggaccacactgtctctgccacgcacggagacatggaccagaacactagggacatcatcatgagggagttcagatctggatcttctcgtgtgctcatcaccactgacctgctggcccgtggtattgatgtgcagcaagtctcccttgtcatcaactacgacctgccaactcagcccgagaactacctccatcgcattggtcgtagtggtcggttcgggaggaagggagttgccatcaactttgtcacccgtgaagatgagaggatgctgttcgacatccagaagttctacaacgtggtcattgaggagctcccggccaatgtcgctgacctgctctagattatatcttaggaatgcagtaaggtgcttgataaagttcgtttttgttgaatatctcccaactctcagttttggagtggtaaggtctgggtctgtttgaatcgtggttaaggatggtctgagtttttcttgttatgcaatgtccggaaatttttgtagtgcgtaggctgtgccatctcctgggttagctgggatagagtaactctcatgagtattttacttttcgttgtgaagttattttatt

SEQ ID NO: 1100 - DNA, 1275 bp, Triticum aestivum
tataaatgtacacccaggaaaacctacaaaattttctctcccatatgcaggagcaaacagcatgatgaacgctactttggttaagccatactgcccatatcaatatctactttccattggttccttaaagatcaatatctattttcctttgatcttgcagtaggcatacatgcctgagccaacgaagccaaggccttggccgatgacattaagcagatcaaaaggaagcccaccgaagagtacccagccaagtccaacagtgaagaaatccttcaaattgccacacattgactgtgtaagtgcagaattcaggattgtattccagaagatggtgtagttcaatagaaatgctagtatacatgaaaatagcagcaccacctgaaaaccaggggaataaaggtaaggaaattcaatagttttcttgaggtcgccctgaatatatgtcaagaacagtactgcaggtccacaaacaagtccattgcaccacatcaggccaaagctattcagcccactagattttccaatacgatttatagttgcaagataaacagctgtagttatattggtcactttgacaatgagattgacatgaaacggccttgagacctaccctggtgtcaagcgcatcaccatcaagccccagactgaccgctgggtcttccccgagaccaagaccggcatcattgttcttgctgagggtcgtctgatgaaccttggatgtgccactggccaccccagctttgtcatgtcctgctcattcactaaccaggttattgctcagcttgagttgtggaacgagaaggccaccggcaagtacgagaagaaggtgtacgttctccccaagcacctcgacgagaaggtcgcggccctccacttgggcaagctcggcgccaggctgaccaagctcaccaagtcccagtctgactacattagcatcccagttgagggtccttacaagcctgcggcctaccggtactagtgtgtccagcacggctagcggctggcctgagcctgagtcggagcagcggcaccaacgggaactctatcaactatcctgtttcccttctattatcttacatgctgtctcttaggcggaggatttgttattatggttatgttttgagccttgtgagggttgggagaggcggcgtttgcttttgcccagaaataatggcattattattggtttgagtgaggaggtgtgcttttccagatacagttttgtctcgtttgttctgccatgtctgaaatccttcgcaagctgttgctcatatt

SEQ ID NO: 1101 - DNA, 722 bp, Triticum aestivum
cgcaggccgcttctccctgcgtctgaacccatcagcatagtgtccaggtcctggagaatcgctcgactttctacatgaacgtctcgggttcacgcccatccgccgccccggctccttcgacttcgacggcgcgtggctgttcaactacgggatcggcatccacctgctgcagtcggagcatcccgagagcctaccggcgaagaaggagatcaaccccaaggataaccacatctctttccagtgcgagagcatggtggcggtggagcggcggctaaaggagctgggcatcccgtacatccagcgatgcgtggaggagggcggcatctacgtggaccagatcttcttccacgaccccgacggcttcatgatcgagatctgcaactgcgacaacctccccgtcgtcccgctcgccgacaagaccttcgccatggccgcctgcaagagggtcgcctccgtcaagcaacagcagctgcccatgccagtcgcgcaggtagcgcaagcgacccctgctccgacagcggccgcggcttcacagtgcattccggcgccgaacccggccttgcagcgcgtcggcggcgaagaggcagcgcatatctcgtgcgcgtgaggggtgggaggccggggtagccaggccgcccaactggtgggtggcgcgctccgtggagttgtggtttttgtacattgtgatataacagtgtgcatatgaataaatggagcagagt

SEQ ID NO: 1102 - DNA, 670 bp, Triticum aestivum
ccaagctagccatccttgctcgcccctagccaatgtcagcctgccatggctaatctttccccaggcgcagaactcgccttcaggactacctctcaccgcacaacgctgcccgtgccgccgtcggggtgggcgcggtgaccctggagcacgaagctgcaggggttcgcccagagctacgccaaccagaggatcaacgactgcaagctccagcactcgggcgggccgtacggggagaacatcttctgggggtcggccggcgcggactggaaggcggcggacgcggtgaacgcgtgggtgggcgaaaagaaggactacgactacggctccaacacctgcgcggcggggaaggtgtgcgggcactacacgcaggtggtgtggcgcgcgtcaaccagcatcggctgcgcccgcgtcgtctgcaacaataacctcggcgtcttcatcacctgcaactacgagccccgcgggaatatcattggacagaaaccatactaactgtgatgcacgtcttcgcagtacatacatgcattacatacatctagtctttcgtccctaatcgcatgcaccttcgtatgcctaactagccagagggaccgagcgagtaaataaaaggaatgccgtaataagccatgtattccatcctggactgtaataaataatgagcctttctatg

SEQ ID NO: 1103 - DNA, 696 bp, Triticum aestivum
ccccttgcctcgctccggattgctagcgcggcggccgcacacttccttcccttccctaccagttaccagaccccaagcacccgagatggcaactacattcacggcaccaattctgtgcaacttgagagcgaacccacgcctgaaccacagcaccagacaacaacaggcggacttgcacctgagctcggcgagaatggcgcccacgctgacaggctcaagagcacggagcgacttgcgcgcggcggcggtgtacaaggtgaagctgatcgggccggaggggaaggagagcgtgatcgaggtggcggaggacagctacatcctggacgcggcggaggaggccggcgtggagctgccctactcgtgccgcgccggcgcgtgctccacctgcgccggcaaggtcctggagggcggcgtggaccagtcggaccagtccttcctggacgacgcgcaggtcggcgccggctacgcgctcacctgcgtcgcctaccccacctccgacctcatcatccagacgcacaaggagtccgacctctactagcagcactagtttcattcaatctttggcactgtgagtgtgatctgatccgcctgcataatgtagctgtcgcctgaatcttagctaaattttattctcacccccccttcatcgccgtcgacttttacctgagcaagtgcactttgtattttccaaaaaaa

SEQ ID NO: 1104 - DNA, 1068 bp, Triticum aestivum
ccaacctgtccggtgggcgcaacccgagcttggactatggtttcaagggcgccgagatcgccatggcctcgtactgctctgagctgcagttcttgggcaacccggtgactaaccatgtccagagcgcggagcagcacaaccaggatgtgaactcacttggtctgatctcatccaggaagaccgccgaggctattgacatcttgaagatcatgtcttccacgttcctggtggctctgtgccaggccattgaccttcgccacattgaggagaacatgaagacagcggtgaggaactgcgtgatgcaggtggccaagaagaccctgagcatgaacaacatgggcggcctccacatcgcccgcttctgcgagaaggatctgctgaccgcgatcgaccgcgaggcggtgttcgcgtacgcggacgacccgtgcagccccaactacccgctgatgcagaagctgcgggcggtgctggtggagcacgcgctggccaacggcgacggcgagcgcgccctggagacctccatcttcgccaaggtggcggagttcgagcagaacatccgcgcggcgctgcccaaggaggtggaggccgcgcgcgcgtccgtggagaacggcacgccgctggctccgaaccggatcaaggactgccgctcctacccgctctaccagttcgtgcgcgaggtgtgcggcaccgagtacctgaccggcgagaagacacggtcgcccggggaggagctgaacaaggtgctggtggccatgaacgagcgcaagcacatcgacccgctgctcgagtgcctcaaggagtggaacggcgagcccctgccgctctgctgagcagtcgacgagagaaggtaacaccaaaggaaaagaaaacacgtacacacaaagtgaatatagaagtgttcaagactgtgaagcgggaggttcctggtatatctacgttcattgtacttagttaagttgatgttactgttgttttttctcgctgccgccatgccatgagcaggcgaggcaggcagcttctcaaacttgtgttgttgtaacttgtatgatgggagcttaagtacattac

SEQ ID NO: 1105 - DNA, 998 bp, Triticum aestivum
  misc_feature (773)..(791): n = any nucleotide
agtaccttgccaacccggtgaccaatcatgtccagagtgccgagcagcacaaccaggacgtgaactctctgggccttgtgtcggccaggaagaccgccgaggctgtggacatcctcaagctcatgtcctccacatacatggtggcgctgtgccaggccatcgacctccgccacctggaggagaacatcaagacctccgtgaagaactgcgtgacgcaggtgtcgaagaaggtgctgaccatgaaccccaccggcgacctctccagcgcgcgcttcagcgagaagagcctcatcaccgccatcgaccgcgaggcgtgttcagctacgccgacgacgcctggcagcgccaactacccactgatgcagaagctgcgcgccgtgctcgtgggaccacgcgctcaccgccggccccggcgaagccgagagcgaggccacggtgttctccaagatcaacaagttcgaggaggagctgcggtcggccctgccgcgggagatcgagccgcccgcgtggccttcgagaacggcaccgcgcccatccccaacctgatcaaggagagcaggtcgttcccgctgtaccgcttcgtccgcgaggagctcggctgcgtgtacctcaccggcgagaagctgctgtcccccggcgaggagtgcaccaaggtcttcctgggcatcagccagaacaagctcatcgaccccatgttggagtgcctcaaggagtggaacggcgagcccctgcccatcaacgtctgaagcatcgtccgcgccaccgtggaggannnnnnnnnnnnnnnnnnncttccagagtacatccaaaaataagacgcttaattcgttcgtgcatgttcttcttcagttcctatcgccttttgcctttggttgttcgtgcgttggtgttgatcgacgtgtggcgttgttgttgattgtgtagctgctctgccgcagctttacctaaagatattgtcgttgtattttggggtgaatcatgctaatactatgtggctt

SEQ ID NO: 1106 - DNA, 1392 bp, Triticum aestivum
gagcggggcggcgagctgggcgacccaggggcgggcgtaggcgccccagtcgtcggggatgaggccgtacatggcggcgcggggcttgcccttgaccccgagcgactcgaggcgcgggaagcgcgcgagcaggcgcgccgggggacacggcgtagcagaagggcacggtgacgtgcttccgcgtgagcgcgtcgatgtggtgccagcggcggcaggccagcgaggccgcctcgcggtcgcgcgggtcgtccacgtagccgagcaccaggtgcagcgcctcctccgggacgccgctgccgtccaggctgagcgcgcggctgagccgccgcggctccggagcctccccgcccatcggccgggccgggccggtccccgcctacggctccgcgccggcccgccggggatctggtccggcgaggaggggcgggggcatggggattgatttccctcccccccttcccgctggcttttctccgatggtggtgccaggccatcgacctccgccacctggaggagaacatcaagacctccgtgaagaactgcgtgacgcaggtgtcgaagaaggtgctgaccatgaaccccaccggcgacctctccagcgcgcgcttcagcgagaagagcctcatcaccgccatcgaccgcgaggccgtgttcagctacgccgacgacgcctgcagcgccaactacccactgatgcagaagctgcgcgccgtgctggtcgaccacggccctgaccgccggccccggcgaggccgagagcgaggccacggtgttctccaagatcaacaagttcgaggaggagctgcggtcggccctgccgcgggagatcgaggccgcccgcgtggccttcgagaacggcaccgcgcccatccccaacctgatcaaggagagcaggtcgttccccctgtaccgcttcgtccgcgaggagctcggctgcgtgtacctcaccggcgagaagctgctgtcccccggcgaggagtgcaccaaggtcttcctgggcatcagccagaacaagctcatcgaccccatgctggagtgcctcaaggagtggaacggcgagcccctgcccatcaacgtctgaagcatcgtccgtgcgaccgtggaggagaggaggaggcttccagagtacatccaaaaataagacgcttaattcgttcgtgcatgttcttcttcttcagttcctatcgccttttgcctttcgttgttcgtgcgttggtgttgatcgacgtgtggccttgttgttaattgtgtagctgctctgccgcagctttacctaaagatattattgtcgttgtattttggggtgaatcatgctaatactatgtggttctttttttgcttgtattattactgtcctagtaaaatgttttgcttctatataatacaatacat

SEQ ID NO: 1107 - DNA, 568 bp, Triticum aestivum
cagcgtgtccaagcgccgtgctggggatcgtgcgcccccgccggggagatggcgcgctccggcgtgcgcgtcaacgccgtctcgcccactacatcccgacgccgctggtgatgcgcatcctggagcagtggtacccgaaggccagcgcggaggagcaccggcgtatcgtggagggggacatcaacgagatggagggcgcggtgctggagccggacgacatcgcgagggcggcgctgtacctggcgtccgacgaggccaagtacgtcaacggccacaacctcgtcgtcgacggcgggttcacggtggggaaggcgcccaacatgccggcaccggcgctgtgaaacgaagcgagctctttgaaataaatttacgtcgtgttgcattgcaccagaagtagaaccaccgagcattacgtttttgtttcagaattgaaacaacgaattgtcctcaatgtcgaggacgtgcatacgctgaccccatgcggaaatagatgagagcagcccggttgttgttatctttctggctactaaccggatccgtatgtggtgcttactacaccacatgaaga

SEQ ID NO: 1108 - DNA, 734 bp, Triticum aestivum
acgcgtcgagcaaggagtaccgcggccacggtgtcgagagccacgagggcagccacgagctcgtccgtgcccggcgagccggtggcgcagctgcatgagcggcagggcttcacggcggagatgtcgtacgatgcacaaaattctaaccatgggtacggatttggcgcaacattccaacgcagcctttcaatgtcatcatcaccggacaacagtagcaccgttcaggatgtgaccagctcgtacatgaggagcagcgagagcagcgtcgacctcttctcagcggcggcgcacatgtcgccgcagttcatgggcatggccatggacagggaggccagggtgcaccggtacagggagaagaggaagatgaggcggttcgagaagaccatcaggtacgcgtcgcggaaggcctacgccgagaccaggccacggatcaaggggcggttcgccaagcgcgccgacgccgacctcgaggtggaccagtacttctccgcagccgcactgtccgactccagctgcggcgttgtgcccactttctaggccggctcggtggagagaccatgagcgttcctccttccatggtcgatcgacgcctacatgttggttggctctccttaatctgccaaatattcagaaatttattggaggcgtcaaagcttcacctgtaaatatatggaaagatgccggatagatctttcttctcttctacctatcaaaggctaatgaactgacgtcag

SEQ ID NO: 1109 - DNA, 857 bp, Triticum aestivum
gcggcggagtagggtttcacctgcatccattctcaacgttagcaggagcgagtgggagtccggccatggcgccgtcgcagcccaagtcagggctcttcgtgggcatcaacaagggccacgtcgtcaccaagcgcgagctgccgccacgcccgtccgaccgcaaggggaaaggtaccaagagggtgcattttgtcaggaacttgattagggaggttgctggattcgctccctatgagaaacgtatcactgagcttcttaaggttggaaaggacaagcgtgcactcaaggtcgccaagagaaagcttggtactcacaagagagcaaagaagaagagagaggagatgtcaagtgtccttaggaagatgaggtctgctggttgtgtggtgctggtgacaagaagaaatagagcgtggctagttggtgaattttatccgaaaactcggtcctgtattaccagtccgtacctatagagctatggccattgtgttggattttggaactattaaatttgacgctcttaagcccgtggtttctattctgagaagaccaatctttttaagatttttagtttggtgcctttgttttattattacttgctttgtttgattacttggcacaaagctgtttattgcaattatgtagcgtgtctgggttttgtacctgcgattgttgtatgttttcagtaggtgaattgctataagaagccctgccacggtgtggtcttggatcccatatccccattacagcatccatgtctggcataatatcttgatttaccaattgtcaactgtatgagcatctattaatagcgccttcctagtacaaaacatcttcatatatgtaaggtgtatttgttt

SEQ ID NO: 1110 - DNA, 653 bp, Triticum aestivum
  misc_feature (372)..(375): n = any nucleotide
ctggcggcggattagggtttcacttgcatccattctcaacgttagcaggagcgagtgggagtccggcccatggcgccgtcgcagcccaagtcagggctcttcgtgggcatcaacaagggccacgtcgtcaccaagcgcgagctgccgcctcgcccgtccgaccgcaaggggaaaggtacaaagagggtgcattttgtcaggaacttgatcagggaggttgctggatttgctccctatgagaagcgtatcactgagcttcttaaggttggaaaggacaagcgtgcactcaaggtcgccaagagaaagcttggtactcacaagagagcaaagaagaagagagaggagatgtcaagtgtccttaggaagatgagnnnngctggtggtggtgctggtgacaagaagaaatagaacttggctagctggtgaattttatccggaagcaaagtcctgtattaccagtccgtacctatagagctatggccattgtgttgacactatctttagcccgtggtttctattttgagaagaccaatctttttaagatttttatacatgagtctggtgcctttgtttgattacttggtactctgctgtttattcagttatgtagcttgtctgggttttgtacctgcgattgttatatgttttcaagc

SEQ ID NO: 1111 - DNA, 1293 bp, Triticum aestivum
gggcctctcatatacgccaccgcgcgcgccccgctccgctcctcctctcccttcccttcccttcctcggcgaccgccccaggaagcgcctccccgcccgcctccgccaggaaggaagggggccgtcgtcgggtcgggtcgggccggccatggcctacagggcggaggacgactacgactacctcttcaaggtcgtgctcatcggcgactccggggtcggcaagtccaacctcctctcccgcttcacccgcaacgagttcagcctcgagtccaagtccaccatcggcgtcgagttcgccaccaggagcatccgggtcgacgacaaggtcgtcaaggcccagatctgggacacggcaggccaggagaggtatcgggcaattacaagtgcgtactatcgaggggccgtcggtgcgcttgtcgtgtacgatgtgacacgccatgtgacctttgagaacgtggagaggtggttgaaggagctccgggatcacacagatgcaaacattgtcatcatgcttgtcggcaacaaagctgatctccgccatcttagggctgtatcagtggaggatgccaaggccttcgctgagagggaaagcaccttctttatggaaacatctgcgctggaggccatgaatgttgagaacgccttcactgaggttctgactcagatctaccgtgtggtcagcaagaaggccctcgacataggcgatgaccctgctgctccaccgagagggcaaaccatcaatgttggtggcaaggatgatgtctctgctgtgaaaaaggcagggtgctgttcatcctaaattcgttttgcttgtgaagagggaccatatgctcacctgattatatgggtagctgcaaatatgacatcctttttgcctcctaacctggttgtttgcgagattatactggagcaccaagaatttcgttgagacatcaagatttaaccccaggttgataaggggggaaatgctaactttggaatgtcagtgattttgtggttgccttttatggtttcttagctgctgtattgtcccacctcaattgacacaagaatcctctcaacatttcactgtgcagccttacctgataaaggttgtaatgggagctatggttcattacttctcttggctttcctgctgaatggatgtgtactatgtagccctcagagattatactgtatcttctgtatcacgataggttatgtctacttggtaaatgtcatctgtaactggtagccagttttacactgttatattgtgtatctttcttcccagatgtacagaatttgcattga

SEQ ID NO: 1112 - DNA, 588 bp, Triticum aestivum
catgtcgccgtcatcacggcctggtgaacgtgttcgccacgctggtgtccgtcttcaccgtggaccggctggggcggcggaagctgttcctgcagggcggctcgcagatgctggtgagccagctggtggtgggcaccctgatcgcggtcaagttcgggacgagcggcgtgggggagatgcccaaggggtacgcggcggcagtggtgctcttcatctgcctctacgtggccgggttcgcgtggtcatgggggcccctggggtggctggtgcccagcgagatcttcccgctggagatcaggcccgccgggcagagcatcaacgtgtcggtcaacatgctcttcaccttcgtcatcgcgcaggcgttcctcaccatgctctgccacatgaagttcggcctcttctacttcttcgccggctgggtggtcatcatgaccgtcttcatcgcgctcttcctgccggagaccaagaacgtgcccatcgaggagatggtgctcgtctggaagggccactggttctggcgcaggtacatcggagacgctgacgtccacgtcggcgccaacaacggcaagggcgccgccatcgcataga

SEQ ID NO: 1113 - DNA, 1346 bp, Triticum aestivum
gtgcctgctgacgccgtgcgaccaggcgccggagatcttcgacatcgccggccacttcgccgggtttaggcagcgccgacgacctgcccaggacccccgtcctatgcaagcccaacgtcggcgccatggaggcggccctcaggatcgccaacgtcaacccttacaaggcgattttcttcgacgacagcgtgcgcaacattcaggctggcaagcgaatcggcctccacacagtgctggttggcacgtcacagcgggtgaagggcgcggatcacgcgctggagagcatccacaacatccgggaggcgctgccggagctgtgggaggaggccgagaagacggaggacgtgctctactcggaccgcgtggcgatcgagacctcggtgaccgcgtagacgccgctggctctcggtgcaccttcagtctgataccccaagcgcaacccgattcgaccccagcctgccggacagatgatcttcacgtggaatgctcttcagcattggccgggaaaccagtacagtatccatcacgaggagaggagggggagttcagaaagtcaggaattaatgcagcatgcgcaccatgccgggccggtcctaatatatgtatatgtatgtgtcgatcagatctttgcttgtaaattactactactagtaaggaggaataataaagagaaaaacggggttacttgtacgcgacttattcgtatttagccggagcaataaatcaaggacttggccagacgatgaacatgtctcctcttctgaataactgaaatatagtacactggcagatgcaaaagatctcttccctattgaattgaaacctggcactgaccagccggagttcacattgtagacttccacagtgtccagtatctgttcgttggaccgcagaccgccgaggacaaacaagctatcatcaaaagtaaccgcagaggcgtatcctcttgggttgctcatgggatcacccatcctccaggcgttgaggcgaggatcaaagatctcaacactggaaaccatgctgtccccatcataccctccaatagcatataggacttctcccaggacagctacagcatggcatcctctccttgctttcatgcttggaagcttaacccagaaaccctcccttggatcatacctttctgctgactgtaagtacttgctaccatcaaatccaccagatgcatagatgacaccactcgattctgctgctgctagagcaaatcttggttgcagcatagacggactacatatccacttcccaagaaaaggatcaaacatctcaacttctgaaaaagtttgtgttccatctcctccacccatcgcatatattttgccattaag

SEQ ID NO: 1114 - DNA, 643 bp, Triticum aestivum
ttggatcctctagagcggccgcctcgcgatctagacacctctctctgtgttagggttagggtcgttcgctccctaagatcagagatggcggtgccgcttctgaccaggaagatcgtgaagaagagggtcaagcacttcaagagggcccatagcgaccgctacattggcctcaagcaaagctggcgcaggccaaagggcattgattcccgtgtcaggagaaagttcaagggatgcacctttgatgcccaacattggctacggttctgacaagaagaccaggcattaccttcccaacaagttcaagaagtttgttgtccacaatgtgtctgagctggagctgcttatgatgcacaacaggacctactgtgcggagattgcccacaacgtctccacaaagaagcgcaaggacattgttgagcgtgccgcgcagctcgacatcgtggttacgaacaagcttgccaggctccgcagccaggaggatgagtagactgtctgtcagaactatgttttggtctggttcgtatgtaggaaagtattccgctgttcttcgttgtgtgactgtcagggatatctgttattccaacctttttgctaccagtgcagactgtaatgcgtcaaagatctactattgcctttataatct

SEQ ID NO: 1115 - DNA, 565 bp, Triticum aestivum
tcgcctcgcaagatggcggtgcctatcctgaagacggcgatcgtgaagaagcgggtgaagcacttcaagagggcgcacagcgaccgctacatcggcctcaagcaaagctggcgcaggccaaagggtatcgactcccgtgtcaggcgtaagttcaagggatgcaccttgatgcccaacattggatatggttctaacaagaagaccaggcactaccttcccaacaagttcaagaagtttgtggtgcacaacgtctctgagctggagctgcttatgatgcacaacaggacgtactgtgctgagatcgcgcacaacgtgtccacccagaagcgcaaggcgatagtggagcgcgccgcccagctcgacgtcgtggtcaccaacaagctcgccaggctccgcagccaggaggatgagtgaaatgtttcgaacagtagcgcttttggatcgttttgttccctgtagcagacttaatgccgaatctggaattttctcttctgttcgcctcgaggattcgacgctgttgaacaccttgctatcgaatgctggtcatgctatcgtaccatgggta

SEQ ID NO: 1116 - DNA, 549 bp, Triticum aestivum
agggcaagaagaaggggtccgtctccttcgtgatcgactgcaccaagcccgtggaggacaagatcatggagatcgcgtcgctggagaagttcctccaggagcgcatcaaggtcgccggcggcaaggccgggaacctcggcgactccgtcaccgtcacgcgcgacaagagcaaggtcaccgtcacctccgacggcgccttctccaagaggtacctcaagtacttgaccaagaagtacttgaagaagcacaacgtgcgggactggcttcgtgtgatcgcagccaacaaggagcgcaacgtgtacgagctccggtacttcaacatcgctgagaatgagggcgaggaggaggattagagtgcattgttatattgtagtgcttgttgagttttgatacttgatctgagtacctcctagttatccacctatcttatgttgtgccccgttgaacctggatggtttaatttgaagaatccttatattttgtctccccgactatggatccatatgtctctgaacctagacaagtaatatggagatttgttcttgtttt

SEQ ID NO: 1117 - DNA, 661 bp, Triticum aestivum
tcgctaggcaccaagccggtctcaccgcgagcgagctcgtcgtcatggaggagagcaccggtcaggccgcggcggcggccagcgacgtggcgcctggggccggaggcgcggaggccgcgggcgggatgaaggtggtggtggcggtggacgcgagcgaggagagcctgcacgcgctgtcgtgggcgctcgacaacgtcgtccgcctccaccccggcgcgtccgtcgccgtcgtccacgcccagcacagcgtcgaccacttcgtctaccccgtcgccgcccacggcctggcctacgccccgccgacggcgttggactccatgcggagggcgcaggaggagaactcccggagggcggtggcccgcgcgctggacgtgtgcaggcagaagcaggcgagcgccacggcggcggtggtggagggcgaccccaaggaggccatcttcgaggccgttgaggagatgcgcgccgacctgctcgtcctcggcagccgcggcctcggcatggtcaagagggcgttgctgggcagcgtgagcgactacctcgcccatcacgcgtgctgccctgtctcatcgtcatgccgccaacaaggcgcaccaaagtgagtgacgacgcctaccaggctagtcgaaaggtcgatgaactatactatacctggagatagtgg

SEQ ID NO: 1118 - DNA, 687 bp, Triticum aestivum
acaccggcgggtggccgaccgcgcccgacggcccttctcgtggggctactgcttcaagcaggagcgcaacccgccgtccgactactgccagccgaggccggagtggccgtgcgcgcccggcaggcgctactacggccgcggccccatgcagctctccttcaactacaactacggcccggcggggcgcgcgatcggcgtggacctgctgagcaacccggacctggtggcggccgacccggtggtgtcgttcaagacggcgctgtggttctggatgaccccgcaggcgaacaagccgtcgtcgcacgcggtgatcacggggcggtggacgccgacggccgcggacaacgcggccggccgggtgcccgggtacggcgtgatcaccaacatcatcaacggcgggctggagtgcgggcgtgggcaggaccctcgggtggccgacaggatcgggttctacaagcgctactgcgacgtcctcggcgtcggctatgggagcaacctcgactgcaacaaccagaggccgttcaccagcggcgcctcggctgggctcgcggcgcagtgaaaaacgccggcgtgtaccagtgtcagcatgtgattcatgtatgtgtgattccaggagttctcttctctactgtctaaggtgacgagcgtgttgcctcgatccgtgaaagctcgcgcgcgtcagccagc

SEQ ID NO: 1119 - DNA, 736 bp, Triticum aestivum
ttcgcagatccgccctgttatttgcgttggaagaggccagctcttagcgctgaaccacaattcatgttcgcaagctcaaaccaaacgatcagttccataatatttgcctcggacggtctttgggagcatctcagcgatgatgctgctgtgcaaattgtcttcaagaacccaagaacgggtatagcaaaccgactagtgcgggctgccttgaaggaggccacgaagaagagagaggtcagtgtgcatgacctgaggacgatagagcggggcgtgcggcgccatttccacgacgacatcagcgtcgtcgtggtgtacctcgaccggcaccggggtcgccgtcagaccagggtggtggactcgagcagcaactgcaccagcgcccccgtcgacgtctactcctcctccagctcggcttaccgcgactccggttagtaggccagaccagacgggcagcagaagctcagactatatgatcagggtggtaaaatggtggtagggttgcagatcagcaacgcaagctgcaaaccgcaagctgcagtggcagcgtccgaaagagatgcgcggaatgtacataagtagtgcgggcgcgtggaacttttgtctgaagagatgattttttcgtatgtaattgcaggatttaactctctcttttttgtgtatctctgcttagccagcagttaattaacccgtgaactagaacggtagcagcatatatgatactgaaatttagaaaggg

SEQ ID NO: 1120 - DNA, 734 bp, Triticum aestivum
ttataaggccctcaacgacctagcatgtcctcctccgagggcactctcctgaagcccaacatggtcacccctggttctgactccaagaaggtggcccctgaggtgattgctgagtacaccgtccgcaccctccagaggaccgtccctgctgccgtccccgcctattgtcttcctctctggtggacagagcgaggtaggaggcgatccctgaacctgaacgccatgaacaagctccagaccaagaagccctggaacctgtccttctccttcgggcgtgccctccagcagagcaccctcaaggcctggtccggcaagacggagaacgaggagaaggccagggcggcgttcctggtgaggtgcaaggccaactccgaggccaccctcggcacctacaagggcgacgccaccctcgctgagggcgcctccgagagcctccacgtcaaggactacaagtactgattgatctgccttcggtgctgtggcccgtttgggcgtcccgcttaccagtatcattgtcattgtttggtttcctgagtcctgatatatcctcggatatcgaacatcgtttttaataatatggaacttgtgttttcataataccgtagtagtttctttttggagttgaagtaccctgaaaatcgggtgctgcgtatcgtaaattggagcaggtttttgttccatggtcctgtaatttacctgctcatacaatgttaaaacctgtcatattctgagta

SEQ ID NO: 1121 - DNA, 822 bp, Triticum aestivum
cgtcgaggcgtcgcgccggaggagaggatcggaccatggagctcttcccccagcaggccggcatggtcagggactcgcgcgaaaggacggggccggagagggcgccgctgaccatcttctacgccgggaggacggtggtgttcgacgacttccccgccgagaaggccaaggagctcatgcagctcgccggctccttcggcgcgctgccggccgcctccgacgccggcgccgagcccgtctgccagaacgcgccggggcagccttgctttgcagacctgccgatcgcgaggaaggcgtcgctccataggttcctggagaagaggaagagcaggctggccgcggcagatccgtaccctgcgccggtggcggcgccaggggctgggacggccggcaagcctgtgccggaggacggcggcgcgccgtggctcggcgtcaactccgcgctccagctcaactgaaggatttgacgagccggggagaggaacaaatcactgccttgctgcttctccacgtagtagtatatacagtactactctactactacgtggatccttgattgttgccgtttttatcttactaccacgcccgttaattggctgcgtcagggtaattaactgcgtggcgccggctaaatatatatcctgggttaagtagtataagtatgttcttcatctgtttgagaattctttggtgtcgaataaaagaattctttcatgctgatgggatgaatttgttactgtatgcgagtattactaattacctagcttagcttcctaagctgtattaaatgtagcgatgacccgcaataatgctattttttac

SEQ ID NO: 1122 - DNA, 467 bp, Triticum aestivum
agcgatcccccgtcaccaacagccgaagaaagcatggatacccaggtcaagctcgcagtcgtggtgaaggtgatgggccgcaccggctccaggggtcaggtgacccaggtcagggtgaagttcctggatgaccagaaccgtctcatcatgaggaacgtcaagggccctgttcgtgagggcgacatcctcaccctgctcgagtctgagcgggaggccaggaggctgcgctgagcggctgcttttcctgtcttcggaagtaaactctactgcatttaaatcaacttcttgaacgctggctttgtcttttgcctaggctatggaaatgtaagcagtacttaatatgttgcagttttcttctgttgcctgaattaaagtgcacttgatgttgtgagacttgataatccttgcacacctctgggttatttgaattgattggatgaatgatatattgtatcctatgatttgag

SEQ ID NO: 1123 - DNA, 252 bp, Triticum aestivum
cctggtcgcccacatccacagccacggccacggcaactggcgcgcgctgcccaagcaagccggcctgctgcggtgcggcaagagctgccggctccggtggatcaactacctgcggccggacatcaagcgcggcaacttcaccgaccaggaggagcagtcaatcatccagctgcaccagctgctcggcaacagatggtccgcgattgccgcccggctgccggggaggacggacaacgagatcaagaacgtgtg

SEQ ID NO: 1124 - DNA, 841 bp, Triticum aestivum
gtggaaggctgctgttagccatggcctctgctgaaggaggagacaaataccggtccttcctgcacggcgacggcgagaagaacacggtgtggaggcatggagcccctcccaactacgacctcgtgaacaagctcttcgaggaagagcggaccaaggaatgggccgaggggtctgtggaagagagggtgcagcgcttgctcaagacctgggagatggagttggtccacaaggtgcggcccgaggaccagaagagcgtcaaccccaagaactactccgccaccaccaacgggctgaagcctctgacgcgggaggaggtgatggccatgggcggctacaacgcgttcctggcgaccacgctgccgccggagcaccgcatctacgacccggacgcggagtcggtggagtcggccacgtccaccttcctcacggcgttcccccggggcttcgccatcgaggtgctggacgtgtacagcggcccgcccaggatcgccttcaagttccggcactggggctacatggagggcccgttcaagggccaccctccgcacggccgccgcgtcgagttcttcggcgtctgtgtcttcgacgttgatgaggacaccaaggtggagaaggcggagttcttctacgagcgtggcaactttcttgcgagcttcttgagtgcgcctgcttctgcttctgcttctgcttctgctgcgtcggcttcaggctgccctgtgatgagaggagactgatgcgcgacggaatcgacgaaacatgcatgtcactagctagtattgtctccagagttcggatttggctatattccatgtaatgccaagaaatgtttaaataaaaaaag

SEQ ID NO: 1125 - DNA, 690 bp, Triticum aestivum
cgcgaccgggccccctacccgcggaccaggtggtgaaggacctgtccggctccttcgccttcgtcgtcttcgacaaccgcggcaggtcggggtcgggggcggcggtgttcgcggcgcagagcacggacggcggggtgccgctgcactggggcgtggcggcggacgggtcggtggtgatctgcgacgaccgcggcgtggccaaggccgggtgcgggcggtcgtacgcgccgttcccgcccgggtgcatgttccacagcgagggcgggctcaagagcttcgagcaccccatgaaccggctcaaggcgttcccgcgcgtggacagcgagggcgtcatgtgcggcgccaacttcaaggtcgacgcattcaccaagatcaactccatgccccgcgtcggcagcgccaccaactgggccgccacctgggacgacgccgccatctagctgggctggtgtgcatcacctcgccggcgccgctcgcctagctcgtcggacttctgaatttgggcttaccgcattttacttactttttttctttggcaatgtacattctgatctgatctgatctgatctgagccgtgtgtgggcgtgggcgcgctgacacgtacggttgtttgcttgtacgatggaggaataagactttgcttccagtccaagagtgctactgagtcgtcacttgttttgagcaaaataa

SEQ ID NO: 1126 - DNA, 723 bp, Triticum aestivum
gacatcagggacactccgcccaggcgtcctccgaggaacatcgcgaggtagatcccttcgaggcgagcgcctgtcgaagcccttcagggcccgccggacacggcgatggcaagcgtggcgtccacggtggcggaattcggcgcgcccgaccggggcgagaccaacggtgcgcgacctcggcggaggacgtcgtggacttcgccgtggatatgctgggcgacgacatcgtggtgcacagcacggcctcgacggcgggcagcggcgcggagatcaggctgggcagcgtcaccggcgggaaggcggcgcgggccgtgtcgtgccaccagagcctgttcccgtacctggtgtactactgccactcggtgcccagggcgcgggtgtacgaggccgacatcatggccgccgccggcgacggtgagaagatcaaccgcggggtggccatctgtcaccttgacacgtctgactggagcccgagccacggcgcgttcgtgctcctgggcggtgagcccggcaagacggaggtctgccattggatcttcgagggcgacatgacatggacggtggcagattgactgattggtgccaaagcatgtgcttaagccaaactaaagacaagtagcggtacatttacaagttcccattcatcactggtggtcttcacgtgtgtatggaccatcgtccaaaaagaacaaagagttgatgaaagaaagtgtgagctgagct

SEQ ID NO: 1127 - DNA, 804 bp, Triticum aestivum
ggaaggaggtgcgcgaggttgggcacggtgacctcaaggatgccgactggtggcccaagatggtgaccgtgcaggagctggccaagacgtgcaccaccatcatctgggtggcgtcggcgctccacgcggcggtcaacttcgggcagtacccgtacgctgggtacctcccgaaccggccgacggtgagccgtcggaagatgccggaggagggcgaagaggagtacaagcagctgcagaagggcgggaaggaggctgacaaggtgttcatccacaccatcaccagccagttccagaccatcctgggcatcacgctcatcgagatcctgtcgaagcactcctccgacgaggtgtacctcgggcagcgcgacacgccggagtggacgtcggacgccaaggccctggaggcgttcaagaggttcggcacccggctgatggagatcgagaagcggatcctggacatgaacaaggacccggcgctcaagaaccggaacgggccggtgaagatgccctacatgctgctgtaccccaacacgtcggacgccggcggcgagaaagggctcgggctcaccgccatgggcatccccaacagcgtctccatctgatcgtgcgtgatctttcttcagtactcctagattggttggttcgtgtctcgcagggtgtattgtgttcctttaatccttttcattcgcttttgggtgattgcggtaattagttgttgtcagggattagtggatgatgggaaatgatgatcgtagatgatgttcatagtgagaggacatgaggcatgaataagcagtcgtgtgt

SEQ ID NO: 1128 - DNA, 487 bp, Triticum aestivum
ccgccgcctcctcggatcgtccctgccggagagacgccagagagcgcgagcaaaccctaacctccgacgatggtgctgcagaacgacatcgacctcctcaacccgccggcggagctcgagaagctcaagcacaagaagaagcgcctcgtccagtcccccaactccttcttcatggacgtcaagtgccagggctgcttcaacatcactactgtgttcagccactcccagactgtcgtggtgtgcccgggctgccaaacagtgctctgccagccaacgggtggcaaggccaggctaaccgagggttgctccttccgccgcaagggcgactaaacctctgaaggaagccaagacgttgttgaactttgagttattccagggtgttggtctgaagattttgcaatgtcggcaaattgaacccatctttggtaatatgatatctagcttgagtattattatgatgaccactgtactatgttccgtttgggtt

SEQ ID NO: 1129 - DNA, 824 bp, Triticum aestivum
atcacaacagaacattacactttctgccaatgacctagtggcttgctgtggtttatgtgtggcgacggttgtgatggaggatatcctatcagcgcatggcaatacttcgtccagaatggtgttgttactgacgagtgcgatccatactttgatcaggttggctgcaagcatcctggatgtgaacctgcttatcctacacctgtgtgtgaaaagaaatgcaaggtgcagaaccaagtttgggaggaaaagaaacgtttcagcatcaatgcataccaagtaaactctgatccacatgaaatcatggcagaggtctacaagaatggccctgtagaagttgctttcacagtttatgaggacttcgcacactacaagtcaggagtgtacaagcacatcaccggtggagtcatgggaggtcacgccgtcaagttgattggttggggaaccagtgatgctggcgaggattactggcttcttgcaaatcagtggaacagaggctggggcgatgacgggtacttcaagatcataaggggcaagaatgaatgtggcatcgaagaagatgttactgccggtatgccctcgacaaagaacattgccggtagcgccttcgcaatttaaagtttgggctgcgccttgtcctctgatgctgttggaattagctatttgcctgtcaagtttaagcgggcaaattagcattgatggtaccaggattctgtattctgtgcactagctattaatgtgtccgttaatggcaataaaacaattattatcaaggcatctgtgagtgacaaacattatccatttcattggcaaaaatgaagctgagc

SEQ ID NO: 1130 - DNA, 703 bp, Triticum aestivum
agggggacgcctcgccatgaaggcgctcatcctcgtcgggggcttcgggacccgcctacggcctctcacgctcagcttccccaagcccctcgtcgatttcgccaacaagcccatgatcctgcaccagattgaggccttgaaagatgttggggttacagaggtcattttagccatcaactaccgcccagaggtcatgattaatttcttgaaggattttgaggataagcttggcatcacaatcacatgctcccaagagactgaacccttgggaactgctggccctcttgccctagcaagggacaagcttgtggatggatctggcgagccattctttgtcctcaacagtgatgtcataagtgaatacccatttgccgagctcatacagtttcacaagagccatggcggtgaggcaacaattatggtcactaaggtggatgaaccttcgaaatatggtgtcgtggttatggaggacacaactggagttgtggaaagatttgtagagaagccaaagatatttgtaggcaacaagatcaatgcaggaatttacttgttaaatccgtctgtgctggaccgcatcgagttaaagccaacttcaatcgagaaggaggtctccctcgaattggggtgatcagaagtctaagcatggtcctccaggctttgggtgggtttgggcagccaggggcacatcccggggggggcctac

SEQ ID NO: 1131 - DNA, 625 bp, Triticum aestivum
aggatgacgtcgatgctgtccgcgttctcgtcgtggttcgtgaacccgcgccgcaacccgctggcccgcatccacatgctcaccatctccaaccgcctcaagaactacggcctgaggtacgacgacctgtacgacccctacttcgatctggacatcaaggaggcgctcggcaggctgccccgggaggtggtcgacgcccgccaccagcgcctcaagcgcgccatggacctctccatgaagcaccagtacctccccgacgacgtccgggcactgcagacaccattcaaaagctatttgagcgacatgctggctctggtgaaaaaggaggcagcagagcgtaaagcactgggagcccttcccctctacgagagaacccttccttgaagacatttttccttgatatgcgccacagcttttgctcctcgtagcatcacaatgcatgaaataaaatgcagattatgacactgttcctccttccggtttcatgtccatggcctgtagctcgtgccccttcccaaattaattgcgacagaatttctgttgctgttgctgatataaaagtttgttttggttgacggaattgttgctatagaagtctgaacaagtctgtgctcttggccttttc

SEQ ID NO: 1132 - DNA, 684 bp, Triticum aestivum
ggatttgtgatggaccgctacactcttcttcctgaaacaagagaaagaattgtagcaacagaagtaactgcttggtggaggtatccgttcgagcatatttcccagcttccgtcaaagccattttgcttcacacaaagataccaggatgtaaagaaagttctcgcagacacattctttggtccacctgatgttggtgtatatagcccatcagtgcagaatacattatacctcatggctagggaagttcttaccaggttcccagacatagcatctgttcagcttaggatgccaaacctccactttattcccgtgaacctagggggcaaagaaaatccaggattggtgaagtttgctgatgatgtgtacatgccgactgacgaaccacatggaaccatcgaagcaacgttgagccgcgccaactcaaagctgtaatttcactccatgcttgtggccaggctcatgatttggtttggtttcttgaagatcacagtcgcaaataaacaaagtgttaggggggaagctagcacaaccccttgcaaaagggaaaaaggacgtaaactttgcatatgtattcagctaattgacttgtacatggctagctagagttcccccatcgtaaattttactgttgtacagaaccttcagtgttcgttgtccccacatgctataatatagcctgttttt

SEQ ID NO: 1133 - DNA, 815 bp, Triticum aestivum
atggcgctggcatcaaggcgcgtccgtcgacaccttccaccgccgcgggctgtgggccatcaaggccaagcacggcggagccttccccaaggccgagaagccagccgccgtcgccgagcccaagttctaccccgccgacgacgtcaagccccgcaccgccagcacccgcaagcctaagcccaccaagctcaggtcgaccatcacgcccggtacggtgctgatcctgctcgctgggaggtacatggggaagcgcgtggtgttcctcaagcagctcaagtctggcctgctcctcatctctgggcctttcaagatcaatggtgtgccagttcgccgggtgaaccaggcttatgtcattgccacatccacaaaggttgacatctctggtgttaacgtggagaagtttgatgacaagtacttcgccagggacaagaagaccagggcaaagaagactgaaggggagctgtttgagactgagaaggagaccaccaagaatctgccagaatttaaaaaagatgatcagaaggccatcgatgctgagttgatcaaagctattgaggctgtccctgaccttaagaactatcttggtgctcggttctctctcagggatggtgacaagccccatgagatgaccttctaagttgctacaagttcctgagttttggatgtgttttgcctagattgttgctgaaatttgtaccctgttagttgacttcctatgtcagttgaagtgaccgtaagatattatgagaagatcaagagaatccttatctgctttggtggttctttttttacttatgcttaatggaacagtttgt

SEQ ID NO: 1134 - DNA, 1226 bp, Triticum aestivum
ataaaagctcgaattgttttgttcacgtctgtctgaagattacaaaacaaagaactccacatgtgtctgtagcgagctagaaataaagtaacggcccatagttatctatcctctcgagccttgagctccggcactggcgccgtcaggtctccttgcgatcgccgctgccggctccggttccgttgctgtccgcgacctccaccggcggtagagtcatgtcgggcttgtagatgttgtggacgatggaagcgccggcgaggagggaggcgaccaccaccaccgacgaccacgccagcgagggggtccccgtcggcacccgcccgccgccgaacttcttctctgccgccgcctcctcccttcttcagccgaagcgcccgcacgcctcgacccaagggatcccaatggcgccgacctccaagatggcgctgggcatcaagcgcgcgtcgcggtcgcacacctaccaccgccgcgggctgtgggccatcaaggccaagcacggcggagccttccccaaggccgagaagccagccgccgtcgccgagcccaagttctaccccgccgacgacgtcaagccccgcaccgttagcacccgcaagcctaagcccaccaagctcaggtcgaccatcacacccggcacggtgctgatcctgctcgctgggaggtacatggggaagcgcgtggtgttcctgaagcagctcaagtctggcctgctcctcatctctggacctttcaagatcaatggcgtgccagttcgccgggtgaaccaggcttatgtgattgccacatccacaaaggttgacatctctggtgttaaggtggagaagttcgatgacaagtacttcgccagggacaagaagaccagggcaaagaagactgaaggggagctgttcgagactgagaaggagaccaccaagaatctgccatccttcaaaaaggatgaccagaaggccatcgatgctgagctgatcaaggctatcgaggctgtccctgaccttaagaactaccttggtgcccggttctctctcagggacggtgacaagccccatgagatgaccttctaagttgctacaagttcctgagttttggatgtgttttgcctagcttgttgctgaaatttgaaccctgttagttgacttcctatgtcagttgaagtgaccgtaaaatattatgagaagatcaagagtatccttatctgcttcggtggttcttttttacttgtgcttaat

SEQ ID NO: 1135 - DNA, 848 bp, Triticum aestivum
gaacaatggataccctgccggcggagaatggtgcaaagcattaacaaaatagcctggttggaatggcgtcgctgtacgctcacatcacaaccagactggaagggatcatcctgacttcaccagctgtgcgtgtaaaaccagcgcatccgattgttggggccgtggcaccgatattctctctgatagcacccaagttccaattcaagggagcaaacaagcggggcattccggtgtctcgcgaccccgccgcgctgctggcgaagtactctgacccactggtctacaccgggccgatcagggtccggacgggccatgagatcctgcgcatatcctcctacctgctgcacaacctgaagaaggtgactgtcccgttcatggtcctgcatggcaccgcggaccgggtgacggacccgctggcctcgcaggagctctacacggaggccgcgtcgaggcacaaggacctgaggctgtacgaggggttcctccacgacctgctcttcgagcccgagcgcgacgagatcgccgccgacatcatcgggtggatggaccggacgctcggtctgcaggctgtatgagtggtagttgttgtctgaatatggggaggagatgggcatcatgtgtaggccgctcagatcgcggcaatgggattgcagtcatgggcttcatggcatggcatggcaaggcatgcatgatggctttgatctgattcttgccggtgttttctgaaagtggtctgcagattgtctgtgatattcttccccatcttacgatgctgccgattgcagaccaatgaattgggaagccggtggcttgtgctttgtatgaatgctgcaatatatatctataat

SEQ ID NO: 1136 - DNA, 645 bp, Triticum aestivum
ctagctcgcccgcagcgccgcggcctcctccctcccatcctccccaccggcagccatggcgacggagctggcctacgcgccgcccatgaagtcgggcaagctcgggttcgagggcacgcaggaggtgcagcaccgcatccgcatcaccctctcctccaagtccgtcaagaacctcgagaaggtgtgctcggatctggtgaagggcgccaaggagaagcagctcaaggtcaagggccccgtcaggatgcccaccaaggtgctcaacatcaccaccaggaagtccccctgcggagaagggaccaacacctgggatcggtttgagatgcgggtgcacaagagggtgatcgaccttgtcagctccccagacgttgtcaagcagatcacctctatcaccatcgagcctggcgtcgaggtcgaagtgaccatcagcgaccagtagttatgctaccccaagatatgtgtctttaaatctttttacaagggtggagagacacctccaacgtaccaagatatttttgaaactttctgtagtatgagaactgggttttgtatgactaggttctttgcttcgtgattctaagtgcctatcgtcctaagttatcttccgtcaattttcgtgccctgttgtgtgtgctggaatgacat

SEQ ID NO: 1137 - DNA, 816 bp, Triticum aestivum
agtgagaaacgaaaacatctacatgctggctttttccttacggtgtcccctgaatctattcagcttgttgctgagcatgctgctgcaaataacaaggttttcttgatgaacctctccgctccctttatctgtgagtttttccgtgatgcccaagagaaggttcttccgtattctgactacatctttggaaatgaaaccgaggcaaggatcttctctaaagtccgagggtgggagactgagaatgtcgaggagatcgctttgaagatctcacaactgcctctggcttctggaaaacaaaagaggattgctgtgattactcagggtgctgatccagtagttgtggctgaggatgggaaggtaaaaacattccctgtgatcctattgcccaaggagaagcttgttgacaccaatggcgctggtgatgcgtttgttggcggcttcctctctcagttggttcaagggaagagcatcgaggactgcgtaaaggccggttgctacgcagcaaacgttatcatccagcaatctggctgcacttaccctgagaagcctgacttcaactaggccaaattcagcgattctacggaaagcaacacttaaccgcttgatggttcggcttgttctccctgtattattttgaggctttccatctgatccggcctaattttcggccgtggatatctgttgtactgctataatcggtacctttatctttggtataaggcatggttgccattatatggggtgttacttgtggccgtcttatccaagtatatgccgaagcgtggtcagaccgacgatactgcttgaaggcacgag

SEQ ID NO: 1138 - DNA, 854 bp, Triticum aestivum
agtacatctacaccatcgacgacgactgcttcgttgctaaggacccatcaggaaaggacatcaatgcacttgagcagcacatcaagaaccttctgagcccttcaactccatttttcttcaatactctgtacgacccgtaccgtgagggtgctgattttgttcgtgggtaccccttcagccttcgcgagggtgccccaactgcaatgtactttggccttatgggtgatggccagcctattggtcgctacgatgatatgtgggctggatggtgcaccaaggtgattactgatcatttgagcctgggtattaagactggtctgccctacatctggcacagcaaagcaagcaacccgtttgtgaacctaaagaaggaatacaacggcatcttctggcaggaggagctgatccccttcttccagtctgtgactctctcaaaggaggccaccactgtccagaagtgttaccttgagctggccaagcaggtgagggcgaagctcggcaaggtggatggctacttcaacaagcttgctgatgccatggtcacatggattgaggcctgggatgagctcaacccaccaaagggtgccattaccaccacaaacggccctgctctgaagagcaagtgagaggcagtagcatacatatacggttcgctttttcatgtgaactatccatactgaaatactcctgtttggttagtgctgatgagatgagaaatatcacttcgttgtaacttaaagtttaccttcttccctggacaactgccctggtggttttagggaatttacatttttgcttgtgttgggacagttgtattgtcggaatcggatcaccttcaaatagaataaagttac

SEQ ID NO: 1139 - DNA, 1285 bp, Triticum aestivum
  misc_feature (584)..(584): n = any nucleotide
  misc_feature (610)..(610): n = any nucleotide
acggcccatttatgtcatcactaactgtctaaccattctgacagagggaagttttgttctcgaatatttgactgtgaacggtcgaaactactgtataaaattagcctggaaagcaacgacgggactgacatttgcacattccaagggttgaacgaaaaaaccaaagccgcaactcacctggttggcaaaaccccagaagaggacagagacgacgacgctgccccacagctcggccatgacatagaataagcagaagctccaaatcctgaggatagctaccggtccaaggaagctcgggccgagcgccgccagaagcttgtcggcgagggcggtgggatggatggcatccctgagcgggtagagcacgaagccgaagaggccgaagaaggcgatgaaggggaatatgacggtgtagaagagcgcctcccgggagagcacgtcggagagcttggagtatgccagcatgaagccgatggccatgggcaggttgctatcctcaggatttggagcttctgcttattctatgtcatggccgagctgtggggcagcgtcgtcgtctctgtcctcttctggggttttgccanccagatcaccacagtcgatgaagcanaagaattctaccctctatttggccttggggcaatattgcccttatcttttctgggcgtactgtgaagtatttctcaaatttgcggaagaccatgggtccacggagttgatggttgggaggtatctttgaaaggaatgatgggcatagtggtacttcttgggcttgtcattacttccatctattggggagtgaacaacttgtgttgaatgatccttctcttccaaaatctgaccacaagaagaaaaaggtcagtagaatacttgaatgtgcttcccttgtttattaccacttacatattctgatagcctttgtttcaacagaacaaacctaagcttagcatgaaagagagtatgaaagttctgatctcttcaaaatatgtgagggaccttgctaccttagtcgttgcatatggcattagtatcaatcttgtggaagtcacatggaaatcgaagctcaaggcacaggtaaatttttccggcttttgtttttcttctttccttgtactcctttaaccttttcatcgcagtaatgattccttattcattttggcagttccccagtccaaacgagtactcatctttcatgggtgatttctctaccgcaactggaattgcaactttcacaatgatgctgttaggtcggattatattccaaagatttggctggggagtggct

SEQ ID NO: 1140 - DNA, 784 bp, Triticum aestivum
ccaagctcgcagccatgcctcccaagctcgacccgtcccagatcgtggaggtgtatgtccgcgtcaccggcggggaggtcggcgctgcgtcgtccctggcccccaagatcggtccgctcggtctctccccaaagaagatcggagaagacatcgccaaggagacggccaaggactggaagggcctccgcgtcaccgtcaagctcaccgtccagaatcgccaggccaaggtgtccgtcgtcccctccgccgcagccctcgtcatcaaggcgctcaaggagcccgagagggaccgcaagaaggtcaagaacatcaagcacagcggcaacatcagcctcgacgacgtcatcgagatcgccaagatcatgaaggtccgctccatggccaaggagatggccggcaccgtcaaggagatcctcggcacctgcgtcagcgtcggctgcaccgtcgacggcaaggaccccaaggatctgcagacggagatcgacgacggcgaggtggagatccccgcttaagaaggcttggctttgggcaggttgttatgtgaggctgctgaagtagtttctcctatctagatgcttcctgatgcatttgagagaatggatgtgatatcttcacttgttctactcttgctgaagaagaaacttttgtcatgctttagtggttccattgtgagactattttttactggtttaatgagtaccttgcggaatcaatcaatgttattatggcagctagaatatcatatgttgagttttgtcattgatgttttgagcgattcttatat

SEQ ID NO: 1141 - DNA, 585 bp, Triticum aestivum
cgtgaagcgctgaacaccaatgatgacgccctattgatgttgatgtttgctcagtgtgtgcgaatgtcaggcttgtgtttgattgtacgagggatgactgtaggaaagtgagggacagcttgtggcggtgccgaggctgctacttctgctttcctagatgcgaaaaatgtggtggctgtatcagtccggaggatctagtcgaggctgatcttgcttgttcagatcttatgtgcttggattgttggcttacggtccctaaatgcagcacatgcaatcggccttactgtgagaggcatgaaaatttgatggtgtccttgtcgatggctggccagttttcatgccagcgttgcaaggagctcggctcatcacacgagagtcaggaagatgactattagaagtgagctttccacccctcttctgttactgcaaacacttgaggtacttactaagaattctgtactagcatttgctattggattttaccgacgcttcgagcttacaatgctagctgaacatatcatgatgctgaattatataccgatgtttgtcaaatgaagcagatacatatttcatggaccagttaaa

SEQ ID NO: 1142 - DNA, 559 bp, Triticum aestivum
gacggcggcgaacgtggagaagctcccggggctcaacacgctgggcgtctccatgtcccgcgtggactacgctccgtggggagtgaacccgccgcacacccacccacgtgccaccgagatcatctacgtgctagagggctccctcgacgtcggcttcgtcaccaccgccggcaaactcttcgcccgcaccgtctgcaagggtgagcttttcgtcttcccccgcggcctcgtccactaccagaagaacaacggcggcgcgccggccgccgcaatctcggccttcaacagtcagcttcccggcacgcagtccctcggcctagcgttgttcgcagcctcaccgccggtgcccaccgacgtgctggccagggcgctccaggtcgacggcggcctggtggaggccatcaggtccagattcctgccaaagtaaccagcatgcatgcatgcatgcatgttggttgggtcagctgtacgtgcatacgtgctgctaataataaaggaccacgtaaaagtgcagttttaattcattcgcttgataatatgttttgtagtactatattct

SEQ ID NO: 1143 - DNA, 645 bp, Triticum aestivum
atccacccgggttcgtgcgcgccacgcggagcaagtcggagctgcagggacacgccggactcggtgttcttcacgctggacatgctggacaagttcctggccatggcgctgcccaagggcgccacccaaggaccacccgtacacgtgcccgatgggcccgaacgcgccgccgctggagtccgtctctctgccgccgatgctggtggccgtcgcggagaaggacctcatccgcgacaccaacctcgagtactgcgaagcactgcgcgccgccggcaaggaggtggaggtgctcatcaaccgcggcatgagccactccttctacctcaacaagttcgccgtcgacatggaccctaccaccggggagcgagcccaggagctcatcgatgccatcaagagcttcgttgcccgccactaaaaaagcatattgtatcacacacgtgcatatggtatcccacaggtgtgtctgccattgtcgatcgaccatatatacgtgatggcttctggattgtatccggccgcctcgtctgttatcagtgtatgcgtccaaagtctttggttatcacgccatctgcagcagcattcgtgatcagtattgtttcatgtcactgtaaggccctgtttggttccaaataaattaccaactta

SEQ ID NO: 1144 - DNA, 1064 bp, Triticum aestivum
gccccgcgaaccatcttccgaaggtgcccttggactcgtaccatggcgactacaaaggcctccacattgatctcgtgtcgcctggaaaagatcctctgcttggagttgacagtgttggtacagtatccgcagctctggtgacttatgcttctatacaattgttgaagccagaccttatcatcaacgctggtactgctggtggttttaaggccagaggagcaggtattggggatgtcttcttagcttcagatgttgcattccatgacaggaggatacccattcctgtttttgacagttatggaattggagcgcgaaaaacatttgcaaccccaaatatagtgaaggaactcaatttgaaggttgggaaactgtcaactggtgattctctggatatgtccccccatgatgagacagcaatactgagcaatgaagctacagtcaaggatatggagggagcagcggtggcatatgttgctgacttgttctcgacacccgctatctttgtcaaagctgtgactgacattgttgatggggagaagccaacagccgaggagtttctgcaaaacctgatctcggtgacgatggcgcttgaccaggcagtgatgcaagtggtagacttcatcagcggcaaatgtatctctgatctctgaacgcccaacgctccgctatgcaggttccacaaattgagggagcctgaatatatattgctggatgtaaatgtttcctggggggcattctcataacccctatgaaaaaaaaaatcttggcgattactcggagccgttgtatgggattttgtagcattttacaaactgcgcagcttagtgaagctcggcttaataaggtggtgtattgttatactggaataaatgatggacattggaactcccatggattcaggacgatggttgatgggtgcaccttggcagctccatcacatggtagctagctttgcaagtgcagtgagcaatgaatactttccaattgcagtgagcagtaaaggcactcgttttggggagcagctgtgctatatgtatgctgaatcagttaactgcagtaattct

SEQ ID NO: 1145 - DNA, 1070 bp, Triticum aestivum
gatgacccgaagatcagatgaacaaactgtcaggaagaacttgagagtgagacttggtggacgtggtgtctgttcaccatgcccggatgtggaaatacgggaagcggggtgcacatacttcctattgatgacacagttgaagggattacaggaaacttgtttgacgccttcttgaaaccatacttccttgaagcttaccgtcctttgagaaagggagaccttttccttgtgaggggtggaatgagaagtgtggagttcaaagttatagagactgacccggcagagtattgcattgttgcaccagacactgagatcttctgcgatggtgaacctgttaagagggaggacgaggagaggcttgacgatgttggctacgatgatgttggtggagtcaggaagcaaatggcccagatcagagaactggttgaactcccactgcgtcaccctcaacttttcaagtctatcggtgttaagcctccaaagggcatattgctgtttggaccacctggctccggcaagacccttattgccagggctgttgccaatgagacgggtgcattcttctttctgatcaatggcccagaaattatgtccaagttagcaggagaaagtgagagcaatctcaggaaggcatttgaagaagcagagaagaatgcaccatcaatcatcttcattgatgagattgattcaatagccccaaagagagagaagaccaatggagaagttgaaaggcgtattgtgtctcagctgttgacccttatggatgggcttaagtcccgtgcgcatgttattgttatgggtgctacaaaccgcccaaacagtattgatcctgctctcagaagatttggtaggtttgatcgtgagattgacattggagtccctgatgaagttggccgccttgaagttctcaggattcacaccaaaaacatgaagttagctgaagatgttgagctggaacacatttcacgagacacccatgggtatgttggtgctgatcttgctgctctttgtactgaggctgctcttcagtgcattcgcgagaagatggatattatagatccttgaggatg

SEQ ID NO: 1146 - DNA, 764 bp, Triticum aestivum
aggaggctcctcttcgggatgaccaaccggtccattctcgtggtggaggacatcgactgcaccatcgaactcaagcagcgggaggaagccgacgaggaacctgccaccaagtccagtcctacagagaagaagaaggcagaagacaaggtaacgttgtctgggctgctcaattttgttgatggcttgtggtcgacaactggggaggaaagggtcatcatcttcaccaccaactacaaggagcgtctcgacccagcactcctgcggcctggcaggatggacatgcacatccacatggggtactgcaccacggaggccttccgaatccttgccaacaactaccattccatcgactaccatgccacctacccagagattgaggcgctgatcgaggaggtgacggtgacgcctgcagaggtcgccgaggttctgatgaggaacgacgacactgatgttgccctccatgatcttgtcgatcttctgaagttaaagaagaaagaggccactgagatcaagtctgaaagtgtacgggcgggggagaagaaagatgacaaaggggtggtgctgaagaatgagttcgcagaaaacggaagcagctaggagtgcggaaactgacggtgaccagcgactacgcgtgtatcatgtagataggtcgtactggagatccattggaacatatgttgatcattttaacagctaataacattgcatttgttgtagtggttcggcgcacttgtctttaacttgacacaatgtgcttcaaaata

SEQ ID NO: 1147 - DNA, 1290 bp, Triticum aestivum
ccgcagatcgaagaacttcaagcctctaggatgtgatattcagaagaaaaattacaagctgagactagaaaaggtaaaacaggaaggaaggggaacctcaatgttgctaccgagatactgccgagtcggaccttctcttcatatggttgaagttcgcataagcaaaaggcgacactctagaatttcacaagttctacaagaacctttcacaacaccttgaaggacgttgtttggaaatccgacgatcttcagatccaaccttcctagcagcagcttgggagaaggggggatgggtaaactattagcatcccattcttcctgagttgatccattctcaggagctggatcaagataaattgttcaccacattttgtaagtaccggtggatatccctgttgtcagctgtgcttgtcctccactggtgttgtatatgctgcattttgagagacttcttggagcattttaagtcaagcacaatcaagtaggttttggtgtatattaggcatgtgggttttcgcaagtcgtatcgagttcactttggaacaatgcaatcaggaattcgcaaacatttagccgaatatgcttgtaaagtcgcaccggccggtcatcatttcgttcccattgtaaattgtgagaccatggaagttaatttcttgtttttgccttgttacatacacttgttccttcagctgtaaatcagaactgaagggtgaaacaaaaagcctgaattttcagaggatgatacatgaggggatgcagcttcctcgtttgtccttgtccttgtttccttgttccggcgggggatctgcatcgccgtcggtcttctctcctaccatctcacggctgttttcctgtgacttccgccgtcctcgtttactccggccaatctgcatgatccggaaggccagaaggtagcggcagacccggagtccattcttgaagagcggcggcgccgatggttttgatcccgtcgagtccatcttggccatcatgaccctggcgaactcggagtagttgatctggccgtcgccgtcgaggtcggcctcgcggagcatctccgcgagctcctcgtcggagaggcgctcgccgagcttgaccatgacgtgccggaactcgtcgagcgagatgaagccgtccttgtcctggtcgaagacgcggaaggcctcgcggagctcgtcctcggcgccgcgcatcttgcggtcgaggagggtgaggaactcggagaaatccacgacgccgttgccgtcggtgtccacctccgcgatcatctcccgcagctcctcctccgac

SEQ ID NO: 1148 - DNA, 1965 bp, Triticum aestivum
gccgctcgcgatctagaaccccaaaagttcttgtttcgcaaaccacacgaagaaaaaagcaaaggagatggcgaccacgaattggacgctccccgaccaccccacgctccccaaggggaagacggtggccgtcgtcttgctcgacggatggggcgaggccagccccgaccagtacaactgcatccatgtcgcccagacgcccgtcatggattcgctcaagaatggtgctcctgagaagtggagactagtgaaggctcatggaactgctgttggtctcccaagtgacgacgacatgggcaacagtgaagttggccacaatgctcttggagctggccgaatctttgctcaaggtgcgaagcttgttgatgctgctcttgcttccgggaagatttgggaagacgaggggttcaattacatcaaggaatcttttgataagggtactctgcaccttatgggtttgttgagtgatggaggcgttcactcccggctagaccaagtgcagttgattgtgaaaggtgccagtgagaggggagcaaaaagaattcgccttcacattcttactgatgggcgtgatgttttggatggcagtagtgttggtttcgtagagacaattgagaacgatcttgctcagcttcgtgagcagggtgttgatgcacggattgcatctggtggtggaaggatgtatgttacgatggaccgctacgagaatgactggagtgtggtcaagcgtgggtgggatgcccaggtgcttggagaagcaccacacaaattccaaaatgcacttgaagctgtgaagactctaagagcagagcccaaggccaatgatcagtatttgcccccatttgtgattgttgatgagagtggcaaatcggttggtcctatagtagacggtgatgcagtcgtgactttcaatttcagagctgatcgcatggttatgcttgcgaaagcacttgaagtttcctgattttgataaatttgaccgtgttcgtgtaccaaaaattaagtacgcttggatgcttcaatatgatggggagttgaagcgtccaaacaagtaccttgtttccccacctttgattgagaggacatctggtgaatacttggtgaagaatggtgtccgcaccttcgcttgcagtgaaacagttaagtttggccatgtcacatttttctggaatggaaaccgttcgggatactttgacgagaccagggaagagtatgtagaaattcccagtgacagtggtatcacattcaatgagcagcccaaaatgaaggcacttgaaattgctgagagaactcgggatgctatcctcagtgggaagtttgaccaggtgcgtattaacctgccaaacggtgacatggttggtcacactggtgatattgaagccacagttgttgcttgcaaggctgctgatgaagctgtcaagatggtcttggatgctgtggagcaagttggtggtatctatcttgtcacagctgatcatggaaacgcagaggatatggttaagaggaacaaagctggccagccgatgctcgacaagagcggcagcatccagattcttacatcgcacacgcttcagccagtccctgttgctatcggaggccctggtctccacccaggagtgagattccgctccgacatccagacacccgggctcgccaacgtcgccgccaccgtgatgaacctccatggcttccaggctcctgctgattacgagacgaccctcatcgaagtcattgacaagtaaaaaaaaaaacactgcgccctctgaagccaaaattgctgcagccgattttgtcgctatagttttggggtgggtcaaggaatgatcgcatcattgaataatttgagatttgccagcacgcttgctcgaactcatatgtaacattgagaaaggtggattttacttgcagttagctctattttgtaatttggggtattgccatgctggtttgcttaacataccgata

SEQ ID NO: 1149 - DNA, 830 bp, Triticum aestivum
ccgaggtttgagacttgctaccagattgctcttgcaatcaagaaggaggttgaagtcttgaggcaggcggtattcaggtcatccaaattgacgaggctgctttgagagagggtctgccactccgcaagtctgagcacgctttctacttggactgggccgtgcactccttcaggatcaccaactgcggtgtccaggacaccacccagatccacacccacatgtgctactccaacttcaacgacatcatccagtccatcatcaacatggacgctgatgtgatcaccattgagaactcgcggtctgacgagaagcttctctccgtcttccgcgagggtgtggtgtacggtgcaggcattggcccgggtgtgtacgacatccactcccccaggatcccgtccaaggaggagattgccgaccgtgtcaacaagatgctcgcggtgctcgacaccaacatcctgtgggtgaaccctgactgcggtctcaagacccgcaagtacgccgaggtcaagcctgcgctcaccaacatggttgaggccgccaagcagatccgcgccgagctcgccaaggcgcagtaagccgtgcttgtatagcagctccccacttttaattgcaaggaggatgtcaccaccatagccgtgtttacttttgaataatctgggtctcgtatccacttgttggttaggctagtttgtttctcggtgcggcgcgatgtgctcatcccttgatttggtggtttttgaggcggttgtcggtgtgtattgtaaactgagtggcgaattgttcatctaagtctgagtttgttacgttatgtttcaaattacaaatttctc

SEQ ID NO: 1150 - DNA, 878 bp, Triticum aestivum
gccgtctccgcactctgccgccgcagccgcagccgcagccatgggcgcgtacaagttcgtgtcggagctatggaggaggaagcagtcggacgtgatgaggttcgtgcagcgcgtgcgttgctgggagtacaggcagcagccggccatcgtgcgcatcaccaggcccacccgccccgacagggctcgccgtctcggcttcaaggccaagcaggggtatgtggtctaccgtatccgtgtcaggcgtggtggcaggaagaggccagtgcccaagggtattgtctatggtaagcccaagcaccagggtattacccagctcaagttccagaggaacaagaggtctgttgctgaagaaagagctgggcgcaggctgggtggtcttcgtgtgctcaactcctactgggtgaatgaggactctacctacaagtactttgaggtcatccttgttgatgttgctcacagtgctgtccgcaatgacccaaggatcaactggctctgcaagcccgtgcacaagcaccgtgagcttcgtggcctaacgtcggccggaaagaagttccgtggtctgcgtggcaagggccaccgccaccacaagaacaggccctcaaggagagccacctggaagcgcaaccagaccgtctccctccgccgctaccgttaaactgccctatgcacaccttgatagtatttgtctgagccatcagattttgctacctttgtatggagactccttgaagctcgtgcttagaacctttatgtcgacgcatatctgttgaactatttgctatttgcctgtgttaccagaacaacgaatgggttagtaatcgtatgctctgtgctatgctgtcatatgtttggtcgttcaccttataatgttatggtgt

SEQ ID NO: 1151 - DNA, 780 bp, Triticum aestivum
ttcccggtcgaccaagcgtcgcgccattccgacccgactgcggccaatgcggacctagctcaccgacgaccagatcgccgagttcaaggaggctttcagcctcttcgacaaggatggggacggttgcattaccaccaaggagctgggaactgtcatgcgttccctggggcagaatcccactgaggcagagcttcaagacatgatcaatgaggtggatgctgacggcaatggaacaattgatttccctgaattcctcaaccttatggcccgcaagatgaaggacactgattctgaggaagagctcaaggaggcattccgtgtgtttgacaaggatcaaaatggttttatctctgctgctgaactgcgccatgtcatgaccaaccttggtgagaagttgactgatgaggaggttgacgagatggtccgtgaggctgatgttgatggtgatggccagatcaactatgacgaatttgttaaagtcatgatggccaagtaagttgcattaccatctgagggaagcttgagtaatcagaccacaatattacctatccaggtgccattttgtgggatggctattgtattaaaccgaaaacaatataacactgtgctgtgtcatatgttgtaggcaatgattgtttgccttgaagattttatagatcctgctctggtctttctgattttgtctgttccgtttttttatgtttggttcgtcaacttttcaagagtgtagccacaatctgttaatgaataactatatgtcagtgttccatgattacccct

SEQ ID NO: 1152 - DNA, 776 bp, Triticum aestivum
aaactgtcgacaaggcacagctgatcgtggatgtgaggaaagccctctacgcctccaagatctgcagctacgcccagggcatgaacatcatcaaggccaagagcacggagaagggatggggcctcaacctcggcgagctggccaggatctggaagggcgggtgcatcatccgcgccagcttcctcgaccgcatcaagaaggcctatgacaggaacggtgagctcgccaacctcctcatcgaccccgagttcgcgcaggagatcatggacaggcaagccgcatggaggagggtcgtctgcctcgccatcaacaacggcgtcagcacccctggcatgtccgcgagtctggcctactttgactcctaccggagggacaggcttcctgcaaaccttgtccaggcccagagggactacttcggggcgcacacctacgagagggttgacatgcccggctccttccacaccgagtggtacaagatcgccaactcgaagatctaagatgctgctgctgctctaccaagagacggcccatcacgtttcgtcttcttggtatcctttgttgctgccagtcatgagtccttttcctgtaggggaggaaccgctgtttaatttttatcatttgagtaacgagtcctgtatttattttctacaaggagatcacatattctctccagtctccactacttccatgtgattgatgaaccctggtgggaagacattgccattctgaattagtttgaataaaatgtgtttttacctacctgtcttcgatagcca

SEQ ID NO: 1153 - DNA, 708 bp, Triticum aestivum
cgttgatggtccctcgagctatggactggagaggtggtctgggccgctagctttaacatcattcccagcagcactggtgctgctaaggctgttggtaaggttcttcctgagctgaatggcaagcttaccggtatgtctttccgggttcccactgtggatgtgtcagttgttgatctcactgttagaaccgagaaggctgcatcatatgatgacatcaagaaggctatcaaggctgcatctgaggggaagctcaaggggatcatgggttacgttgaggaggatttggtctccaccgactttgttggtgacagcaggtcgagcatctttgatgccaaggctggaattgctctgaacgaccatttcgtcaagcttgtctcgtggtatgacaacgaatggggttacagcaaccgcgttgtcgacctgatccgccacatggccaagactcagtagagtgctctgctttcctttgtggcgcctggtcagaggtgtccctgctttgtctatgcgaagaataaatgtggatggcgtcgccagacgacgcctggttcatgttagttggacatgagttaccttctgttttccgcatcaactagtatctgtaatggagttgctaatcaagtactcttttttggttgtggtttgtgaagaatatataaatcgttcagtccagtacttgtgtttgccttaatagagagataactctattaa

SEQ ID NO: 1154 - DNA, 688 bp, Triticum aestivum
cgcagcgccaagccgacggggcagcaaccgctggtgcctacccgcctccctccggctacccacccgctggcaagacaggcgagccatccaccgcctgaccccgcacccgccggctacccacccgctggtccgtcaggaaagccggcgaaggcaggcgagccagtgacggcctacccagcgccgcggcgggacccagcaccggcgctccctacggcgccccgcccccgcagtacggctacgggtacccaccgcagcagccggccgggtacggctacccgcccccgccgccgcaaggagggtacggcggctacggctatccaccacagcagcccgccgggtacgggtaccagcagcaggccgtgaagccgccgaagaagagcggcatggggatgggcctcggcgcggggctcctcggaggcgcgctcggcgggctcctcatcggcgacatgatctccgactccgccggcgggtatgatgccggctacgacgccgggttcgacgacggcggtggcttcgatttctagatcgtcggggaggatcggatgtgcagcagcacagttcttttgtacgctcttggtatttattcagttctttcgtcttcagattttccgctcaaaatcgccggcgcctctgtgcgctgctagtgtgatatggtaatgtaaatatgagttttaacatgatatgttct

SEQ ID NO: 1155 - DNA, 880 bp, Triticum aestivum
gtcgtccgcattcagcgccagcgccgcatcctcaagcagcgcctcaagggcccccggcgctccaccagttcacccgcaccctcgacaagaacctcgccaccaacctgtttaagatgcttctcaagtaccgccctgaggacaaggtggctaagaaggagaggcttctgaagagggcccaggctgaggctgaggggaaaaccgttgaggccaagaagccaattgttgtgaagtatggtcttaaccatgtcacttacctcatcgagcagagcaaggctcagctggtcgtcatcgctcatgatgttgacccaattgagctggttgtgtggctcccagccctgtgcaggaagatggaggtcccatactgcattgttaagggaaagtcacgccttggatcgatcgttcacaagaagactgcctcagttctgtgccttaccactgtgaagaacgaggacaagcttgagttcagcaagatcttggaggctatcaaggctaacttcaatgacaagttcgacgaggtcaggaagaagtggggcggtggtgtcatgggctccaagtcgcaggccaagaccaaggccagggaaaggctcatcgccaaggaggctgcgcagaggatgaactaagcctagccttatatgtcagagcatatgccatgtagtttccctttcagtgtgtcctgattttgacgaggaactcgaacccttttagcagcagtgtggaatcgtattgtggttttctgattctctgttcccttctccagacttatgcaaagatcagatgaggtttacccatgtttggattctatatagttttatgtcctttgtcgagtcaaagtttgttgtgtttgacatcttcctaacttggctgggttttggttaacatg

SEQ ID NO: 1156 - DNA, 1168 bp, Triticum aestivum
atctcattgtagagagatcagaccagagcctacctagactactcactcatcttcgtcaagaacttcaccatggttgtcccggtcatcgacttctccaagctcgacggcgccgagagggccgagaccatggcgcagatcgccgacggatgcgagaactggggcttcttccagctggtgaaccacggcatcccgctggagcttcttgaccgcgtcaagaaggtgtgctccgagagctaccgcctccgggaggccgcgttcccggtcgtccgagccggtgcagacgctggagaggctggtggaggcggagcggcgcggcgaggcggtggcgccggtggacgacatggactgggaggacatcttctacctccacgacgacaaccagtggccctccgacccgccggccttcaaggagaccatgcgggagtaccgcgccgagctcaagaagctcgcggagcggggtcatggaggccatggacgagaacctcggcctggacaagggccgcatgaaggccgccttcactggagacggcctccacgcgccattcttcggcaccaaggtcagccactacccgccgtgcccgcgcccggacctcatcaccgggctccgcgcgcacaccgacgccggcggcgtcatcctgctgttccaggacgacaaggtaggcggcctcgaggtactcaaggacggcgagtggctcgacgtgcagccgctccccgacgccatcgtcgtcaacaccggcgaccaagtggaggtgctcagcaacggccgctaccgcagcgcgtggcaccgcgtcctgcccatgcgcaacggcaaccgccgctccatcgcgtctttctacaacccggcgttcgaggcggccatctcgccggcggtgggcgaaggcgccgccgccgcgtacccggactacgtgttcggggattacatggacgtgtacaacaagcagaagttcgatgccaaggagccaaggttcgaggccgtcaaggcgccaaagtcagcttaaggcttaagctcaatcaaggagattaaaaaggaaattatttacctattagctggcttttgttttacaatgaagaaaaaaaatgtatttttgagtttgctcagacgcgtagcagtatgatgtggggatacttgtgattggttcggtgtcaaataattaggaaatgaaatatg

SEQ ID NO: 1157 - DNA, 1033 bp, Triticum aestivum
gctatgttttaccggtactatgatcctgtcaactcgtggactggatttccaaggactcttagaagacctcagttcagctccctcaggcgcaattgtactgcttcatgcatgtgcccataatcctactggtgtcgacccaaccttggaacagtgggaacagatcaggcagctgatgagatcaaaagcattgctgccattctttgacagtgcttaccaaggatttgcaagcggaagccttgacaaagatgcccaatcagtgcgcatgtacgtcgctgatggtggtgaattgctcatggctcaaagctatgccaagaacatgggattgtatggagagcgtgttggtgctttaagcatcgtttgtgggagtgctgatatagctgttaaggttgaaagtcaacttaagcttgtaattaggcctatgtattcgaaccctcctcttcatggtgcttctattgtggctaccatacttaaggacagtgctatgttcgacgaatggaccgtggagctgaaggccatggctgataggataattagcatgagggagcagctttttgatgcgctgaaaatcagagaaacacctggagattggtcccacatcattaagcagattgggatgtttactttcactgggctcaacagtgagcaagtagccttcatgaggcaggaatatcacatttacatgacatctgatgggaggatcagcatggccggtttgagctccaggactgtaccccatcttgcagatgccatacatgctgcagttacaaaactgaagtgaatgataacattgcaaccccttcccaataaaatgttaaattgcctacagcagtgtccgaaggttcaaccagaggtgtgttactactggctgaactcaagaatttgccttgtagactcgctaaacttgttgtctgagacagttttgtacacaccggattaaagatgatggtgatttcgaatcccgaataagctgcagttgtgatgctttcgtacccttgaatgctgtggtatttatcctgcagcgctgtataatgca

SEQ ID NO: 1158 - DNA, 1137 bp, Triticum aestivum
gaaaagagaaaaatccatccggaagcgcgagcaaaggccaaggcagctttgcgtgcgagggcgagggcgaggccgcgtccgattcgacagacgcagggcagggatggacgcccttctactcgacctcgtcggcggcggcgagcggatggggctacgactcgcttcaagaacttcgggggagatctcccccgccgtgcaagcccacctcaagctcgtttaccctgaccctatgctttgccctggcctcatctgccgtggggtgcttaacctgcacattgccctgaacatcggtgggatgctgacaatgctttgcgtgtatcggaaccattgcctggatgtactctgtgccagtctatgaggagaggaagaggttggggctgctgatgggtgcagccctcctggaaggggcttcggttggacctctgattgagcttgccatagactttgacccaagcatcctcgtgacagggtttgtcggaaccgccatcgccttcgggtgcttctctggcgccgccatcatcgccaagcgcagggagtacctgtacctcggcggcctgctctcctctggcctgtcgatcctgctctggctgcagtttgccacgtccatctttggccactcctctggcagcttcatgtttgaggtttactttggcctgttgatcttcctggggtacatggtgtacgacacgcaggagatcatcgagagggcgcaccacggtgacatggactacatcaagcacgcgctcaccctcttcaccgacttcgtcgccgtcctcgtccgcatcctcatcatcatgctcaagaacgcaggcgacaagtcggaggacaagaagaagaggaagaggaggtcctgaacgtgtcctctgcacatcgtagataccatcaccaccgcgctactggtaccaccaccactgctaagtacttgtaggaattaagctggcgcagtaacttggcgccgtgccacccttgttaattcgcgctcgtgtgaacattgtgtgagtttgatgctgctgatgaagcatttgcagatgctgtctgcgttccggatctcttgtgttcctgttaccgtcacgataatagaaacctgagacgatttggtttggtttacgaagaacatggctatgcttgtttgtgatc

SEQ ID NO: 1159 - DNA, 768 bp, Triticum aestivum
  misc_feature (537)..(559): n = any nucleotide
gctttgcaagcatttcagcgaagagttgcatactccaatgttggttacgaccacattgttggatggaggacatcatcaatcaggggggcctccgaactacccaagtgggttgattcgacaagcaagatttatccacatattgtatacgaggaactatccaaagcagaaactcttgatcaatgtgctgatgttgctgatatggacaaggataactgcactctcgaagaacggcttttgagaggacttaagcgtgtgtcatgggaaaaggtggacgtcagcttccataatagcaaagcaagatctgctgcacacagtgtaattcaggttaaagatcctgtcgtccatagcgaaggtgccgatgtcataaagcatatgatcgaccatttcgttacctagtggagtgccgcctatctctggaaacaaagattgtgttgtgatcatacacgagttgctaactgcggagtcgctgagcctggtgagcacgtttatggcaatcccaggaatcaagtgtcagatagacggcgttcagaaagttgnnnnnnnnnnnnnnnnnnnnnnngggtcgtggcatgtcgttcactaatctttcgcaattattatgcaatatgtatgttgtgcggtttgagcatagtatcggctttgtgcttgtaaatgtccaccattgttttatcaatgttgatacgttggcgtgagtttttcaaggggaaacgtcgcaaggatactggtgcaaaggcacacctgatatttgacaaacctgatggcaagcga

SEQ ID NO: 1160 - DNA, 703 bp, Triticum aestivum
agctcacggccccaacgggccatgcagcgcgacgccggatcgacgggtcagctccttcggcttcatcactgacttccttgactctggggagctgccgcccctcatggaccctgcccttgggcggcgacgtcgaccaagtcaccgatttcaagtccacctctgcctacgccaccggtgcccattccggacaccaggttaagatggaacagcacatgccgcagcagccgccgcacatgatgtactcgagcccctacttctccctgccggccgctaactccggcgacatgtcgccggcgatccggaggtactgcaaggcagagcaggtctcggggcagacgtctgcgctcagcccgtcccgcgagaccgggctgagcaccgaccccaacgccgccggttgcgcggagatctcgtcggcggcgacaccgtcgtctcagaatcaagagttccttgacgaattcgacgagtaccccgccctgaacctcgccgacatttggaagtactgaagccagccggagctgcacctaccgcatgattcgctcgtcgattggttctggctcgttgattaattactgaattggattacttaacttggtatgtgatgctggtgttagtggtttgctgatgcagcatcatcttctttccggaggattctcgggtcggatcggatcaggttactatccatccatccagacagacctccagg

SEQ ID NO: 1161 - DNA, 600 bp, Triticum aestivum
tcgggtcgtaggatcggtggccgccctgctcttgctactcgccatcgtcgtgccgtttactcagacccggacgcagagcgcacgggacaaggctgccatggcggaagacgcggggccgttggtgggaggcatcaaggactcgccgatgggccaggagaacgacctcgacgtcatcgcgctcgcccgcttcgccgtctccgagcacaacaacaaggccaatgccctgctggagttcgagaatgtggtgaagctgaagaagcaaactgttgctggcacgatgcactacattacaattcgggtcactgaaggtggggccaagaagctctatgaagctaaggtgtgggagaaaccatgggagaactttaagcagctccaggagttcaagccggtggaggacgctgcaatcgcatgaggcgcgccccagctttgcaaggatctgcagctatggtgttgatgcagctatcaatcggacatggtttagcgtgttctcgtgtaatatcaagaataagtccgcttcttgcaagttgttttaaccacgtctctaaataaaattctctgcagtattattgtactattccgttttgccttttgattgacttg

SEQ ID NO: 1162 - DNA, 887 bp, Triticum aestivum
tgcacatgaatcgaatggtgaagcttcaaaggaagacagttgttcgtctggaagtacagaagatcttgatctgtcaaaggagtatctagtgaagctagtttttgagaaggatgaattattaacctcgaaagatgaagagatcaaagatatgaaggacaaggttttgcgcagtatgcagaaatggaaaatgtcattgcccggacaaagcgtgaatctgaaaattcaaaaaaatatgcagtacagaacttctctaagagcttgttagatgttgctgacaatttggctagagcttcatctgttgtaaaggaaagcttctcaaaattagatacatccgaagattctagtggagctgtaccgttactaaaaaccctactggagggtgttgacatgactgataagcaacttggagaggtttttaagaagttcggagtcgaaaggtttgatccgttgaatgagaaattcgatcctgataagcattttgcacttttccaaattcctgatccttcaaaaccatccggaactgttgcttctgttgtgaaggtggggtacatgttacatgatcgcgtgctccgtcctgcggaagttggtgttactgagggaggtccgtccgaagagcctgaggagaaatcaggtggagattagattaaaattggaatctagaagacgtagctgttcctgcttgacgacaaccggtacctcatcagcgaaggagcttggcgatggcagtgtttcggattgatttttaatggtaaaacacaaggttggcttgttgaaatcccatttgtatgggtgcacgtcacaccattccttagcagtacaacgtttcggagaattttgcgagggctttgagaccttaataagagtatttcttttcacatgatacgatc

SEQ ID NO: 1163 - DNA, 773 bp, Triticum aestivum
tggcgccggggcgaagatccgcgacaagtgggcgcacccgctggggagccggagaaggggtgcctcctgatcgcgacggggaagctggacgggtcgcacatcttcgagcgcaccgtgatcctcctgctgtcggccggggttctcggccccgtcggcgtgatcctgaaccggccctcgctcatgtccatcaaggaggcgcagtccctcttcgccgaggaggcggacatcgccggcaccttctccggccgcccgctcttcttcggcgggccgctggaggaatgcttcttcctgctggggccgcgggagggcgccagcgccgccgacgacgtggtgggccggacggggctgttcgaggaggtgatgccgggcgtgcactacggcacgcgggagagcgtggggtgcgccgcggagctggtcaagcgcggggtcgccggcgtgcgggacttccgcttcttcgacgggttctgcgggtgggagagggagcagctgcgtgacgaggtccgcgcagggctgtggcgtgtggccgcctgcagccccgccgttctcgggctcaccggcatcgggggcgggctgtgggaggaggtgcagcagctcgtcggaaagaggagggtgtggtaactaattgatcgtacaaggcttacaaggctacatatactagtacttgctaggtagaaattgtacattatacttgttgtgaaaaatgcttcacaagataattaatttccctataattttatacttacgttacatgttcatacagagattaaagacca

SEQ ID NO: 1164 - DNA, 640 bp, Triticum aestivum
ccgcatcgcgccgcaccacgatttccacgccggcccgcacggctgcggcatcggcacctgcccgcccaacatgtgcaagggccaggtgctcgacagcatccgcgcctccgccgccgcggcggacggcgccaggaagcgcttcatctacctcggcgacggccgcggcgactactgcccgtcgctgcggctcgccagggaggacttcatgatgccgcgcatggggttccccgtgtgggacctcatctgcgagaacccgggcctgctccaggccgaggtgcacccgtggagcgacggcaaggacatggaggagacgctgctgcggctcatcagccgggtgctcgtcgaggagagcacgctgctgccgctcgactgcaagctcgagtcgatgccggtggccgtccaggacggcatgcccatgcccctcggcgtcaagaactgatccatccgtccctgccgcattaccattaatttggggatcgataccttattttctaatttgcttgcctgatatgctggtgtgtagtgtacgagtttgggtagcgcgtcggtggaagctaattaaggatgagcagttcgatcgccaatggccaactcgatagtagtattgactaatttgtgcgtgtcgtccttagccgcctgg

SEQ ID NO: 1165 - DNA, 718 bp, Triticum aestivum
ctactgatgcctcgtgaaggagtccctccgcctgcacccgccgacgccgctcatgctgccccacaaggccagcgcgagcgtcaaggtcggcggctacagcatccccaagggcgccaacgtgatggtgaacgtgtgggcggtggcccgggaccccaaggtgtggagcagcccgctggagttccggccggagcggttcctggaggagagcatcgacatcaagggcagcgacttcagggtgctgcccttcggcgcgggccggagggtgtgccccggcgcgcagctcgggatcaacctcgtcgcctccatgatcgggcacatgctgcaccacttcgagtggtctctgccggagggcgccaggccggaggacatcagcatgatggagtcccccgggctcgtcaccttcatgggcacgccgctgcaggccgtcgccacgccacgcctggagaatgaggagctgtacaagagggtcccggtcgagatctgagcggcagcctgtgctgctctgcttgggctgttgccccgctcgctgctttcggctaggtgctggatggagctcgtgttgttgtaaattgtgatgaggtgtttgactgccttttgaatgaatctcataaagcgacgacggcagatcgcagatcgtttctccctttattaggtgttccttcggatataatacttttgtttttctgttaataacagtttaacacagcaaatcattcta

SEQ ID NO: 1166 - DNA, 1937 bp, Triticum aestivum
gagaagatgctcgacatcaacctattccgcaaggagaagggcggcgaccctgagcttgtccgcgaatcgcagcgcagacgctccgccgacgccaagcccgaaacaatagaagaaaacgttgcgctcgtcgacgaggtcatcgtcctcgacgaggcgtggcgccagaggcagtttgagcttgacaagatccggcaggagctcaacaagaccagcaaggagatcggcaagctcaaggccaaaaagcaggatgcgacggagctgatacagagcacagaggagattaagaggaggctggccgccaaggagaaggaggtggaggaggccaagaccaccctcgacaccaagctcgtcaccattggcaacctggtgcatgaatctgtgcccatcagcggcgacgaggcaaacaatgctattgtccggacatggggagagaagagactggaggagaaattgaagaatcatgtggatctttgcataatgcttgacatcgtatctttggataagggtgctgatgtagctggtggaagaggtttctttttgaagggtgacggtgttctcctgaaccaggcgttgataaattttgggctatcattcctgggaaaacgagaatttacaccaatgcaaactccttttttcatgagaaaggagatcatggcaaaatgtgcccagttggcccaatttgatgaggagctctacaaagtaacaggtgacggagaggataagtatctcatagcaacatcggagcaaccgctatgtgcttatcatctaggtgatcgaatttatcctgcagatttgccgatcagatatgctgggttctccacgtgcttccggaaagaagctggttcacacgggagggacacagctggcatcttcagagtccaccagtttgaaaagatcgagcagttctgcgccacaggtccaaatgacaatgtatcctgggaaatgcatgaggagatgattaagaatgcagaagatttttatcaggcgattgggctaccatatcaactagtttcgattgtctctggtgctcttaacgatgcagcagctaagaagtatgatttggaagcatggttccctgcatcaaaaccttccgagaattagtatcctgttcaaattgcacagattatcaggcaaggagacttggaataggctatggccagaaaaagaatgatgagcaatcgaagcagtttgttcatatgttgaattccacgctgactgcaactgagaggaccctttgttgtattctggagaactaccagagggagggtggtgttgaagtgccagaggtgttgcggccgttcatgcttggaatagatttccttcctttcaagcggcctcttgttgatagcaaacaagctgctgctgactccaaacccaacaagtctaaaccaaaggggaatgcggcttgagctgtaagggtagcaaaatgaaaattgtttccaggcagataatgatggatccttccttttattaatctctgaatcgtctgtggcatggtgatgatttggtgtcccattttggatgtttggttacaaaatattgcaatccagggcacagtttaccacaaagtatattagtgtttttcatgactattacacccattgcactaattaattgcttatagagattgaagtagcgataaacttgatttattttggtattgcaagctgacgtgtaaatcgctcgttaacctgagtaagcaagtggcacttgtgggacagagaatgaaaatgcctaagatttaccaacatgaagcacactcagacactaaaggtgttcaattagcacataggtacattacaatgactttgtgacattgtagaagccaaatataaaggtggcagaatagatataagaggggatgatgcccaccagcatcatagatattgctcaatatagtattacaaattggatataataaacagacaattcaacta

SEQ ID NO: 1167 - DNA, 594 bp, Triticum aestivum
acggtcactgaggatcacctgccacggctgccgtacctcaacgccgtgttccacgagacgctgcggttccattctcctgtcccattggtgcctccaaggttcgtccatgagaacaccaaactggccggctacgacgtcccagccggcactgagctggtcatcaacctgtacgggtgcaacatgaacaagaaggactgggaggagcccgaggagtggaggccagagaggttcgtggatgggaggttcgaggctgcggacatgtacaagaccatggcgttcggcgccgggaggaggtcctgcgccgggagcctgcaggccacgaccatctcgtgcgccgccatggcgcgcttcgtgcaggacttcgcctggaggctcaaggagggcgacgaggacaaggtggacactgtgcaactcaccagctacaagctccacccgctccacgtgcatctctcgccgagagggaggaagtgaatggcacttttgctgttctttaaagaggaaaattggtagttttgctgttggtaatgaagtgtgtaaaattacgaattggccgtgctcttcagaacttcgtcaaacaagatcgatcgtagcatg

SEQ ID NO: 1168 - DNA, 682 bp, Triticum aestivum
caacgggggatgaatatgctgtatgtgcgtcaggtggcgacggtgatcgcggagatctactttcgtgcagggccggcgtggaacgcgccggtgacgcgcgaggtcaaacacggggtgctacttcgtcagggacggcgtgttcaggagggcgccatcctgagcatcatcgccaccgtgctcgggatcaagtcctacttcctgcttcgcgccgccgcggccacggccacggcaacggcagcggctgctgcgccgggatacccgggggccgtggcggggccgtcgtcggcgggcgagcacaagcccgacggcatcgcgatgggccaccctgctccgatgtacgggcaggcgccgtacgcgcactaccctccgcctccgaacgcgcagggatacgggcagtaccctccccctccaaacgcgcaggggtatggaggacagtaccctcctcctgctcaggggtacggacagttccaccccgctgctccccctcagggtcaaggatacgggaaagccgtgtagattgatcactggcttatgtagttatgtgcaagcatgtcttggttcttcatctatgccatgttcttccgtcttccataattcagctgtgtaaatcaccacacgggtcacagctcgtaggctgttcccgttgtggtgaatgatgatcgtctctgcttgaaagtgcaac

SEQ ID NO: 1169 - DNA, 237 bp, Triticum aestivum
gcggaagaccacgagtgcgagatgagggccggcgagaagcagcgggatgagtgcatggcgaggaggacgctcgcggcgcacaccgactacatctacacccaggagaagcacaactagtggccttcatatctgcgtccatgtaatgatgttagtctgcgtgttcgatctctatcctatagcttcctccttgaacaagggatcgaccccaccgttcatgcaatgcatgcatgcatgcat

SEQ ID NO: 1170 - DNA, 1479 bp, Triticum aestivum
aactcgatcagttgacatggttaagtttaccataacaaacactctacatcaggcggcatacacaaaatataaccatcatcagtagctcggctccggagaggcagaggcagaggcaaagatgggctccaccgcagccgacatggccgcctccgccgacgaggaggcgtgcatgtacgctctccagctcgtctcgtcgtcgatcctcccgatgacgctcaagaacgccatcgagctgggcctcctggagaccctggtggccgccggcggcaagctgctgacccccgccgaggtggccgccaagctcccgtccacggcgaaccccgccgcggcggacatggtggaccgcatgctccggctgctggcctcgtacaacgtggtgtcgtgcacgatggaggagggcaaggatgggcgcctgtcccggcggtacggcgccgcgcccgtgtgcaagttcctcacccccaacgaggacggcgtctccatggtggcgctcgcgctcatgaaccaggacaaggtcctcatggagagctggtactacctgaaggacgcggtccttgacggcggcatcccgttcaacaaggcgtacgggatgtcggcgttcgagtaccacggcacggacccgcgcttcaaccgcgtcttcaacgaggggatgaagaaccactccatcatcatcaccaagaagctgctcgaggtctacaagggcttcgagggcctcggcaccatcgtcgacgtgggcggcggcgtgggcgccaccgtgggcgccatcgtcgccgcgtacccgggccatcaagggcatcaacttcgaactcccccacgtcatctccgaggcgccgccgttcccgggcgtcacccacgtcggcggcgacatgttccagaaggtgcccctcgggggacgccatcctcatgaagtggatcctccacgactggagcgacgagcactgcgcgacgctgctcaagaactgctacgacgcgctgccggcgcacggcaaggtggtgctcgtggagtgcatcctgccggtgaacccggaggccacgcccaaggcgcagggggtgttccacgtcgacatgatcatgctcgcgcacaaccccggcggcagggagaggtacgagagggagttcgagggcctggccaagggcgccggcttcgccgccatcaagaccacctacatctacgccaacgcattcgccatcgagttcaccaagtagatccatgcatgccaaccgtccaccgctcgctttgagatcgtcgtcttcttgctcgccggcgctgctgcatcaacctgctgcatatgtacttcggcttggtgtttgttctgttttcctaattttgttgtcatgctagctctgaatctttctgaattctactggttgtgtcgtcgatctattcgaaatgtactcctgtattaatagtgctgctcttaaaggttgcatgcgatgcaataacatgatttcgctgctttgtttttgtgattatacgattga

SEQ ID NO: 1171 - DNA, 319 bp, Triticum aestivum
cagtggaggatttctacagagcacgggggaaactcttggagttcaatttaccaggaggaatccccgaatcatggccgaagctgctccaagctttgaatgatagaagaagatcctgataacaatagatctgcagcagcatagttttgtgagtgtcagaaatgcgtattatgtatttgtagcctatgccaaacataattacccgataagcattactggcatatctagaaagtagttcggtcaggggccattatttgatctggtactcgagatttgtatagctgattgatcatcgatcgctcaagtttgatgggggcgtgct

SEQ ID NO: 1172 - DNA, 754 bp, Triticum aestivum
cgctcatgttcgtgacggggtgctggtgaacgggccttacgcgctcatcaccaccgccgtgtccgccgacctcggcacgcacagctcgctcaacggcaactcccgcgcgctggccaccgtgacggcgatcatcgacggcacggggtccatcggcgcggccgtcgggccgctcctgacggggacatctccgccaagagctggagcggcgtgttcacgatgctcatggcgtcggcgctcgtcgccggcctgctgctgtcgaggctggtcgtggccgagatcaccacgaagatggcggcgccgcagaggcccgtcgattcggctggcgatctgcccgtgtcgtcgctggaggagccttaggcggggccggagatggccggactgtacattgaattaggatggcacgaggagggtggcaggcggggctgggaaatcgggaggtgcgacgggaagaaggagcgggttccgctctgattttccgtgtagtagggcgctcttgggtctcatgtgattgtgtcgtgctgtgcatatggagtgagtgattgtacgccgaattcgaccggataacagtgcggattattgcgcgctgtctgctcctcgatgtagagcatgtgccgaccatttagaccacggtgaagagcggtgctctctcttttgcagtatcagcgacagatcaaggaaacgaaggccggcattgtactaaatttgtagccacttcggaaagtgtacattgattgtagcgcatgataactgtgaa

SEQ ID NO: 1173 - DNA, 628 bp, Triticum aestivum
catccggcgagaatggttgcgtcaaaatcgggcgagctgagggcgctgttcgcgtcactggaccaggatgcggacggcaggatctcggcggcagagctccgggggtgcatgcgggccacgctaggcgaggacgtgccggcggaggaggccgatgcgctggtggcgtcggcggacgcggacggcgacgggctgctgtgcgaggccgagttcctcgagctggcgcagcaggcgtcctgggcgggcgtggaggagggggacgacgagctgaggacccgggcgccgagggaggcgttcgggatgtacgagatggaggggcagggatgcatcacgccgaccagtctgggccggatgcttggcaggcttggcgccgagcggggcgccggcgagtgccgcgccatgatctgccggttcgaccttgacggcgacggcgtgctcagcttcgacgagttcaagatcatgatgagctagcgacctcgcgcctggacccaagcatatgctcctagtttcgtcttgcatatagctcctgcactcgttcgttcgttcgttcgttcattcgttcattcattagattattatttggtactagtacaagttgtaatggtgatgcacagacgtaactgatctatgt

SEQ ID NO: 1174 - DNA, 628 bp, Triticum aestivum
tccgtcgcctttcctccctcgccctcgcctccccgccgccacccaacccaagcacagagctcccggcttctcccccctacgaggttaggcaaggatggtgagggttagcgtcctgaatgatgctctcaagagcatgtacaacgctgagaagcgtggcaagaggcaggtcatgatcaggccttcctcaaaggtgatcatcaagttcctcatcgtcatgcagaagcacggttacattggtgagtttgagtatgttgatgaccacagatctggcaagattgttgtggagttgaacggcagactgaacaagtgtggagtcatcagcccccgctttgatgttggtgtcaaggagatcgagggatggaccgccaggctgcttccatctcgtcagtttggttacatcgtcctgacaacctctgctggcatcatggatcacgaggaagccaggaggaagaacgttggtggcaaagtgctaggctttttctactgagcgggaattttgtgaaagttgtatttcagaccggtgtgataggatgttatctcaggacatcaaggttgtctactttttgcctgcatagctgctatgcctttgttatgttatgttggattcaagttaattatcgagatccga

SEQ ID NO: 1175 - DNA, 607 bp, Triticum aestivum
cccttcgaggctcaacgacgtctcgccatcatcaacgccggccgccatcgccctcctcgcctacggcttcttccaccggcggcctcatccccggcctttgcttcggcgcgggcctcgggattacgcttttcgggatggcatacatgttcgtccacgacggcctggtccaccgccggttccccgtcggccccatcgcggacgtgccctacttccggcgagtggctgccgctcacaagatacaccacatggacaagttcgagggggtaccgtatgggcttttcctgggacccaaggagctggaggacgttggtggcctcgacgaactggagcaggagctcgccaggatcaaccggactcggagcatctgaaggactctggacatggtggcatacgcagctagaagagccttgtgatctcatctagcagatgaactacatttcaagattttttttaaactttttggtggttgctattgatttaattgatggtactggagatggggagtccagagccggaagcaagctaatgatcaggcagtggtggtggtgtactccccgttactcggctgcagggggtgtggatgtgtccaaacagttataggaagaag

SEQ ID NO: 1176 - DNA, 737 bp, Triticum aestivum
ctcgtcctcgccctccccctccggcgacgccgacggggcccgcctcgacacccccgccgtccctgcccaccgcgtcatcctcgccagcaggtctccagttttcagagcaatgcttgacagtgagatggaagagagccggagcggcgtcatcaagatgtacgacgtgtcctatgatgtcctccgtgctttcgtccactacatgtacacgggggaggctctcctggacgagcaaatggcctgcgatctcctggtgttggccgagaagtatgaggtaaagcacctgaagacctactgcgagaagttcatcacgtccaaggtgaacaacgacaacgccatcgtccattacgcgtttgcgcaccggcacggcgcgaagcagctgcttgaggcctccatgtcggcgctcatggatagcatgcccacgctggcggagcgggaagagtacaaggagctcgtcgagagggacccgaggatcctcgtggagatctacgagacctatgtaagccgacaggacaatactgccgccgagagggattcagattgctgctgtagaaagtgatagctgagggtaaaataaagctattctaaccaatcgtttgcatatgaattcagtaaagtcccagctattccaaatataacagcataaccaatcgtttgcataaaattcgggtctggtgagatatatcttgatgctattatggatcgttgcccagatttcagaatggatccgaagttgactg

SEQ ID NO: 1177 - DNA, 696 bp, Triticum aestivum
caagtcttctggtccaccgccccgactgggtcctcttcttcatacacctgacgctattccagaacgcgtttcagatggcacatttcgtgtggacagtggccacgcccggcttgaagaaatgcttccatatgcacatcgggctgagcatcatgaaggtcgtgctggggctggctcttcagttcctctgcagctatatcaccttcccgctctacgcgctcgtcacacagatgggatcaaacatgaagaggtccatcttcgacgagcagacggccaaggcgctgacaaactggcggaacacggccaaggagaagaagaaggtccgagacacggacatgctgatggcgcagatgatcggcgacgcgacgcccagccgaggggcgtcgcccatgcctagccggggctcgtcgccagtgcacctgcttcacaagggcatgggacggtccgacgatccccagagcacgccaacctcgccaagggccatggaggaggctagggacatgtacccggttgtggtggcgcatccagtgcacagactaaatcctgctgacaggagaaggtcggtctcgtcgtcggcactcgatgtcgacattcccagcgcagatttttccttcagccaaggatgagacaagtttctgtattgatgttagtccaatgtatagccaacataggatgtcatgattcgtacaataagaaata

SEQ ID NO: 1178 - DNA, 974 bp, Triticum aestivum
gagaccgtctttagcgtgagcgagtcgaggcgctgtacgagctcttcaagaagataagcagcgccgtgatcgatgacgggctgattaacaaggaggagttccaattagcgctcttcaagacgagcaagaaggagagcctcttcgctgatcgtgtattcgatttgttcgacacaaagcacaatggaattttagggtttgaagagtttgctcgtgcactctcagtgtttcacccaaatgcttcagttgaagagaaaattgacttttcattccagctatatgatcttaagcaacaaggcttcattgagagacaagaggttaagcagatggttgttgccacacttgcggagtcaggaatgaatctgtctgatgaaattatagagaacataattgataagacgtttgaggaggcagacacaaagcatgatggaaaaattgacagggaagagtggcacaatctggttcttcgacatccatctttactgaagaacatgactctccagtacctcaaggacatcaccactacatttccaagcttcgtcttccattctcaggtcgacgatacctgaaattcttgcagttctttcgaatcggaacatcagaagataagcttgcggtaattttgtaaagttttggcatcggactgtttggaactttggatcggcagagagctagaggcctcggtgctctggaggatgttaaatttgagaacgcaaattgttgtcaaataactttgcttctctcatttgaagaatttagtattgttgggagcctttgggcaagctgttatctcttatctgaagttcccattttctcctctccccctttttggtttttgcctggttagcgatcaggtccaatcctctgggaattctcctgtgtgtacaaaaatggaaacagccttggcattgtttgttatcttttgctgggaagtttctccatcgctttgcaatctatagtgaagtggagcagaaaat

SEQ ID NO: 1179 - DNA, 789 bp, Triticum aestivum
gcatggctgattcaaggaagccaggctcagtgatctttgtgagttttggaagccttgcttgcactacaccacaacaaattgttgagctgggactgggactcgaagcctccatagaaaccgtttatttgggtgatcaaagcaggacctaagtttccagaagtcgaggaatggctcgcagatgggttcgaggagcgtgtcaaagacagaggcatgatcataaggggctgggcgccacaggtgatgatcctgtggcaccaagccattggaggatttgtgacacactgtgggtgtaactcaacaatagagggcatctgtgcaggtgtgcccatgatcacatggccacactttgcagagcagtttctgaatgagaagctggtggtggatgtgctgaaacttggggtagaggttggagtgcaaggagttacacagtggggaagtgaacaacaagaggttatggttaccagagatgctgtggagacagcagtgaacaccctgatgggtgaaggggaggctacagaggagttgagaatgagagcagaagactgcgccattaaggcaaggagggctttcgacgaggaaggttcttcttacaacaacgtaaggctgttaattcaagaaatggaaaacaagacgaatgcatgtggttgatagagattacctaagctcgctttttcggtgtaaacatgaagtgaaacatcctagagtacatatatcatcatatagaattttgtaccaggctcacaggtgattatttagagattatagatgatccaaatgaagggaatatca

SEQ ID NO: 1180 - DNA, 823 bp, Triticum aestivum
ccgagtactacaaccgccccacggcggaccgacgaagaggagagcaaggctcggcggacaaggggaagacctccgctcccccggcgatcgcgaggccaccctcctcaagatggtgctgatgcaggcagatccgttcctgagcgagctgaccaacatgtacgagcggagcacggagaagggctccgtgtgggtcaccatgaagcgatcgtcgatgaagtgtcaggctaggttgaagaagatggcgagtaagggggagcctgtcgagtaccggtgccttgtccgcgcctccgatggcaagaggaacatctccacctcgctgtctgcaaaggagtatctgaaattccaagcttcatatgccctggttcttaaagcccacatgcatgctttgaagaagagggagaggaaggacaggaagaagacggtcgaggcagagaagatacccgagaaggaaccgaagaagcagaagaaatcatcttcgaagaagtctgcagggtctaagtagtgaggtacatgcagaatttaccgagaccttttttgcccacatgtgcggtcaagacgttgtcacctgttttacccttaattcatgtccgcgagatgaagcctgtgaatacctatatagagacgcgtcgtcgcctggcattttgaagcagcgttttgatctggttgtaagcctccctggatggcatgggcatgctttcttgaactgctagatctgaccaccaaaagtcttagttcagtttggaatggttcatcggtttgatggttttaggcctatgatatgaatgaagaatctgtcgcttggttgttggaaaggcaatgctgg

SEQ ID NO: 1181 - DNA, 873 bp, Triticum aestivum
cggtctccttcgtgcttccactcgttctccccgtatcttcctcttatccgtgccacctgcattcctgcttgagatggggggcagagctgctgctgctgggcggcaaggtgtccgccggcggcgcggcaggatctggcgccgtcgccgcgtcctcggcgggagctggacgctgcgtggccggccggcggcgactcgcgccggtgcagccggcggcgctgcaatggcagcatagtagtcacactcgcacccgcaccaccaccgatcagaagccaccacgccaacgctgcgccgccgccgaactttggagaggagacgcggaggacgggaagatgggattcgagaaggagatcctgaaagccggcaccggccccaagcccgtcaagggccagaaggtcaccgtccactgcaccggctacgggaaggatggtgatctgtctaagaagttttggagtaccaaggaccctgggcagcagccattctctttcaacattggtctgggttcagtgatcaaaggatgggatgagggagttatgggcatgcaattgggtgaagtcgcccgtcttacgtgcaccccagactacgcttatggaactggtggctttccagcctggggaattcaaccaaactccgtgctgatattcgagatcgaagttcttagcgccaagtgattcatgatggatccatagggcactgccgcatcgccatgcctctcgattaccaaaataattgtaatgccacatcatgttaagtgccacattatggtgaatgcatcgagtgaaacttcggaaccctattatccttacctgatcctggtaaaaaaacacaaccaaaaaggggggcgaacaaaaagaaaacaaggtaaaacacagcgac

SEQ ID NO: 1182 - DNA, 873 bp, Triticum aestivum
ggcatatgtgcaggcgagaggttgtatcctggtagcatctagtcctgaaattcttacaaaagtcgagaagggaaaggttattaaccggccacttgctgggactacacgaaggggcaagacagagcatgaagataaattgcaagaggaacaactattaagtgatcaaaagcaatgtgccgaacacattatgcttgtagacttgggaaggaatgatgttggcaaggtatccaaatctgggtctgtaaaggtggagaagttgatgaacatcgagcggtactcccatgtcatgcacatcagctccacggtcagtggagagttagatgatcgccttgaaagctgggatgcactgcgagcagcattgcctgttggaacagtcagtggggcgccaaaggtaaaagccatggagctaatagatcagttggaagtcacaagacgaggaccatacagtggtggcttaggagggatatcatttgatggtgacatgcttatcgctcttgctctccgcaccattgtattctcaacagctccaagccacaatacaatgtactcatacaaagctcagatagacgccgagagtgggttgctcaccttcaggctggtgcgggcattgttgctgatagtatcccagacgatgagcaaaaagaatgtgagaataaggcagctgccctagctcgggcaattgatcttgcagagtcggcttttgtagacaagaatagagtgccagttgtttttttagttgttcatcatttttcacccggttcatgttggaaagttgttcattgtttcttcacccagttcatgttgggaagaaagaaacatacccttctactgtctcccgtgaattgaataaatctagagctctaataagatgta

SEQ ID NO: 1183 - DNA, 687 bp, Triticum aestivum
cagcattcgtctccacaggcacggggagacggtcggcgaggctgctggtgcaggaggcggaccggctggcgctcccggtggagtgccgggacaacgggtaccggctgtcgtacgcctgggccgacgacgcggaggtgagggcgacgctgggcatccgggaggggtcggtcggcgcgtggagccggtgcgtgacgctgacgcacttccggcacgacgtggccagcaccgtgccgtaccacgccaacctgacgcggcgcggctaccgcgcgctggtgtacaacggcgaccacgacatggacatgaccttcgtgggcacgcaggcgtggatccggacgctggggtaccccgcggtggcgccgtggcggccgtggtacgccaaccggcaggtcgccgggttcacgacggagtacgcccacaacctcaccttcgccaccgtcaagggcggcggccacaccgcgcccgagtaccgccccaaggagtgcctcgccatgctcgacaggtggacctccgccgacggcaggctctgagcctctgacctcggccgacggagtactatactgcatacgagtacaaatgagtactgtataattcgatttggatcagtgctatagctgttcacatcatttcatgtacggtgtcgtactattgattgaagtgccatgcacacgagaggacgaagacataaat

SEQ ID NO: 1184 - DNA, 547 bp, Triticum aestivum
ttcggggtgtgctgctggagctggccaccggcagggaggccggcaacggcggcgagcactgctcgctggcggagtgggcgtggcggcacctgcagtcggggaagagcatcgccgacgcggcggacgagtgcatcggcgacgccaggcaaagtgacgacttcgaggtcgtgttcaagctcggcatcatctgcaccggcgcccagccgtcgacgcggccaaccatgaaggacgtgctgcagatactgctgcggtgcgagcaggctcaccggaaaaacctcgacgagaagacgggcgtctccgagtacgacgccgccccgctgctgccagcagtgcgagggggcagtcgccggaaacggctatccgacgccgctgacggcaagggtagcttcgacgtcgtcgtctgacgaaatgtcgtagtgacgtcagaatatagttgtaaggttcagtagtaactaagtagtaagacagtgcagtttcagagcagagcagataacaatggtggaatgttgtacacagtgtgacagccttcagatgagcagttgcttga

SEQ ID NO: 1185 - DNA, 943 bp, Triticum aestivum
caacaacaccggcagggcgctctccgcttaccttgaccgcacccatctcaggagggagctcagcttgcttggcccaatggcctttgcagagaagatggttcttgccgtctttgggggcctgatcgtcctgtggatgacgaggagcctgacggacgacatccctgggtggtcggttctcttccacggcaatgtcggggatggaacagtcaccatcatgatggcgacgctgctcttcataatcccgagcggcaagagcgacggcgagaagctcatggactggggcaagtgccggagactgcagtggcacatcgtcctcctcctcggcgccggcttcgccatcgccgacgggttcaaggcgagcggcctgacggacatcctcgccgggtggctgggcttcctgcggggcgcgccggcgctggccgtcgcgcccgtggcgtgcgtcttcagcggcctcctcacggagttcacctccgacgacgccaccaccacgctggtgctgccgctgctggcggagctgggcaggagcatcggcgtgcacccgctgctgctcatggtgcccggcgccgtcggcgcgcagctctcctacctgctgcccaccgggtcgcccggcaactccgtcggcttcagcaccggctacgtcaccatcaaggacatggtggtcaccggcatgcccgtcaagatcgtcggcgtcgcggctctcaccgtcctgctgccaacgctaggtgttgctgtttttggtatggatcagaaggtataggaaccttaatttttgttgaacatttcatcaatctctagagtgtagactgcaggttggtagtctgtctagcactagaatgttgaggttgtacagtgtatagtcagtggcattaattgcctcatgaacgatatgggatcgtattcttttctgtatctatgagacggtatataaatttgtatcaagcgg

SEQ ID NO: 1186 - DNA, 745 bp, Triticum aestivum
gtatctcagatgggatcttcgatgaagagaaccatcttcgacgagcagacgtcgaaggccctgaagaagtggcacaagacggtgaagaagaacaacagcagcaacagcagcagaaggggtcatcgcatgcctcctcagagacgccaaccacggacacgcccgaggcaggccggcttagccagtgccagttcgtcgccgaggcggcgccggtggcaaaccggcacctccaccgctacaagaccatagcgcacgtcggcgccaccagggcgctctccgactcggactgctccgacacggatgccgaggcgcagacgaggtacctgatcccgcccacgaagcagaggagcctggactcggaggtccgtgtggacgtggacgcggcgacgccggatcaccgtgatagtttctcctttcagaagccgccgcctgctcagaatgcgatggagaaatgatcaaacgggcgtaggtcgtgcttagtatactaatcagtactactaacttgtgttagattagaggatgagcagatcgtcgaggtgggtaggcaactttaccgtgcatgttttcattgttttgactagagattaaggttagtgtgccatttggggtgcatgagaagtcacgggaatttcgatggagttttaggggaaacagtttaattccacgtcgcgaatagaacccttgtgcattgcgtgatggatgatccctaaggttaatgatgaatagtggtgggagtgccgtgatgttt

SEQ ID NO: 1187 - DNA, 1533 bp, Triticum aestivum
aaaactcgtggtccgaccgagtcttcaggcagaagtacatacgtcgacccttatcagtgtcactactttagctgacaacacatagtggattccacacaagcacttggttttattacttagcaacaatacaaaacgtctgacaacaccatcaaccagaatgaggatcattcgcaccactattaaattattatcgaccgaagccacccgaaaccgccgtggctgcacccatcaatcgacgaccatccctgcccctcacacgtcgcagctgagccaaagcggctcgtcgaactcgcccagcgaatcgtccgcggcgggagcgcccagcgacagcgactccacgcccagcgccggcccccacatcggcgtgccgttctcgtaggcgttgctggtgagcctgagcacaccggagccgtcgagccggcacacgtacaggtcgccgtacggctggaactggttcggtcccgagatgggctcggccatgacgccgcccaggttggccgtgaagagcagccactcgccgtccgggctgaagcacacgtggttgatccgctccttgtccgcctccgcgctccccagcagcccaacctgttctacacctcgtggagccccagcgagagcggggtggtgttcacctccgctggcccaatcttcgagaccccgaaagcgacggtccgggtggcgcgcatcgagttcgacacgagcgacctcaccgacgaccgcggcgacgtcgacgtggccgtgaaagagctgacccggccggaggcaggcaacgacgcgttcccggcggtgtcgccgtgcgggcgggtggttggtgtcccggtccggccggtcgggccacaagaacctctacatcgtggacgcggcgcgcggggaggagacgatacggcgggtcacggacggcgagtggatcgacacgatgccgagctggtcgccggacggggagctgatcgcgttctcctccaaccggcacgagccgggcaacgccgccgtgttcagcatctacctggtgcggccggacgggacggggctgcggcgggtgcacgtggccgggccgccggggagcgcggaggcggacagggagcggatcaaccacgtgtgcttcagcccggacggcgagtggctgctcttcacggccaacctcgggggcgtggtggccgagcccgtctcagggccgaaccagttccagccgtacggcgacctgtacgtgtgccggctcgacggctccggtgtgcgcaggctcacctgcaacgcctacgagaacggcacgccgacgtggggcccggcgctgggcgtggagtcgctgtcgctgggcgcccccgccgccgacgattcgctgggcgagttcgacgagccgctgtggctcacctgcggcgtgtgaggtgcagagatggtgatcgattggttgggtgcagccacggcggtttcgagtggcttcggtcgataatattttaatttaatagtggtgcgaatgatcctcattctggttgattgtgttgtcagacgttttgtattgttgctaagtaataaaaacag

SEQ ID NO: 1188 - DNA, 756 bp, Triticum aestivum
ggattccccgtggagcgcgacctgctgcggaagctgctggagcccaaggtgatctcgccgcgggcgatgcgccccgtgggatccaccatccacgtcgaatccatcgtccacggcgccgtcgacgcggccagcagcacggccgcctcgaagacggcggaggaggtggaggcggaggtggagaccgacgcgctgccggcgatcgtcacggactcgagcaaccgcgtccggctggtgaacgacgcgtacaaggagatggtgggcgcgcccgagtgcctgtggctcggcgcggtggccgcgtcgaggaggatcagcggggaggtggcgctggtggtggctgagcaggcgacgctgccggagtccccaggggggttctcgtgcacggcgaagatcgagtgggagtgcggcggcggcgagcgggcttccatccatgcagcgtgcgacgtcagccggctgcagtgcgagtacaggcactacctcttcgcctggaggtttcgcgccgccgatgcatcatcgcccgccgacagccaccgcgccggcggcgaagcatgagacactcaggatacgagctgcgtgcgaaaccaagtgcacaggtcatagattaaggtgcatgttttgttactgttaaaccactaggttaaggtgcatgtttagtggtactggtaaactaggtgaactgtttcctcttttgggaagcctgcatggtgcatgcccgggttctaaagtacatatgatgttgaccggacaacgcaagggaaa

SEQ ID NO: 1189 - DNA, 795 bp, Triticum aestivum
aagcaagcattgagcaatcgaacatggcgaggcttcacctttccgtcgtggcggcctgcgccgtcctcctcgcgctcgccgccccctccctcgccggcgacgccgacatgctccaggacgtctgcgtcgccgacctcgcattcccaatcaagatcaacgggttcccttgcaaggccaacatcacggccgacgacttcttcttcgccggactcaagaaggccggcaactacctaactaacccggctggttcggtcgtcaccgcggctaacgtgctgtcattccccggggtgaacacgctcggcgtgtccatggcgcgcatcgactacgccgtgggagggcagaacccgccgcacacccacccgcgcgccaccgagatcattttcgtcaccgagggaaccctggaggtgggtttcatcaccaccgccaacaagctcttcactaaggtcgtcaccgtcggagaggtgttcgtcttcccgacgagggctcgtgcacttaccacgcagaaacaggggcaactgctctgcactcacgtaaatcgccgccttcaacagccaagcattacaagggcaaccacaagccatcgccaaccaacagcatacatatagagacatagccaacaaccaccagtgccaaccgacgatagactggacaaaggcaattacagggattgataaacgaagaacaatacagaacgcacgtaaaggaccaggttcaaatagggagcctcatgccactacatggcaacatccagcatccatttcggaagaaaaataaatcgtcatgtattgatacatg

SEQ ID NO: 1190 - DNA, 976 bp, Triticum aestivum
gggtgggccaagaggaagcgatcgcccgccagcgttccgaggaggagaacctcggcgctctgcctcctcatgctctcgccggcggcaagcagcgtgttcaggcgccgcagccggagtcgttcgctgcgccggtgcctgccgagttcaagtgctccgtctgcggcaagtccttcagctcctaccaggcgctcggaggccacaagacgagccaccgggtgaagcagccgtctcctccctctgatgccgctgctgccccactcgtggccctcccggccgtcgccgccatcctgccgtccgccgagccggccacgtcgtccaccgccgcgtcctccgacggcgcgaccaacagagtccacaggtgctccatctgccaaaaggagttcccgactgggcaggcgctcggcgggcacaagaggaagcactacgacggaggcgtgggcgccgccgcctcgtcgaccgagcttctggccgccgcggccgccgagtctgaggtggggagcaccggcaacgggagctccgccgcccgggccttcgacctgaacattccggccgtgccggagttcgtgtggaggccgtgcgccaagggcaagatgatgtgggaggacgatgaggaggtgcagagccccctcgccttcaagaagcctcggcttctcaccgcttgagcagctcctgcatggatcccatcgatccatccaaagtttttggtccagtcgatccagtggtgaaattcgttcattcgtttggttaaatttgttctgctcctgtacagattgagtgagtgagtaatactacatacatactccagtagccatatacgtagatataggcagtaagttgtaacgacggaagagtacttgcttcctctttcagatgttgggtaggcgtcagtatattgtactagtcgacagttcatacatactcgtacagagattggtcatgaactagcagtaccgtgtaacataaagcatggatgaaa

SEQ ID NO: 1191 - DNA, 662 bp, Triticum aestivum
acgacgtacgctcggtggtgaccggcgccaacgtggagaaggtgccccgggctcaacaccctcgggcgtctccatggcgcgcatcgactacgcgccgggcgggctcaacgcgccgcacacccacccgcgcgccaccgagatggtcttcgtcctcgagggcgcgctcgacgtcggcttcatcaccaccggcaacaagctcgtctccaagcacatcacggccggcgacgtcttcgtcttcccgcgcggcctggtccatttccagaagaacaacggcgacggccccgcctccgtcatctccgccttcaacagccagttccccggcacgcagtccctcgccatgacgctcttcgcggccacgccgccggtgcccgaccacgtgctcacagcggcgttccaggtcggcaccaaggaggtgcagaagatcaagtccaggcttgcacccaaaaaggcttgactaaacaatactgagcactcctaagatgtttccttggagtgaggacatgattcaatccctgatttgtatttctgctcacttttactcacctgcgttgtttttctggcttcttgatttgttggatcctcattgtgtaatgctgccctgcggcagcaagtacaaaagctcgtgggcgctgcttgtaatgcaataataagatcactcattt

SEQ ID NO: 1192 - DNA, 527 bp, Triticum aestivum
gcgaccaacgtgcgggcgacgtaccactactaccggccggcgcagaacaactgggacctgggcgcgcccgcggtgagcgcctactgcgcgacctgggacgccagcaagccgctgtcgtggcggtccaagtacgggtggacggcgttctgcggccccgccggcgcccacgggcaggcggcgtgcggcaagtgcctccgggtgacgaacccggcgacgggggcgcagatcacggcgaggatcgtggaccagtgcgccaacggcgggctggacctggactgggacaccgtcttcaccaagatcgacaccaacgggatcgggtaccagcagggccacctcaacgtcaactaccagttcgtcgactgccgcgactagattatgtatccgtcgatcaaaggctagctagctatgataagaataagaggctagcttagctacgagtgagctgagactggtcgatgctgttgaataaaagctagcacgtgatgctgcattgtatacgtgtatacagtacgtacatggaatgaaat

SEQ ID NO: 1193 - DNA, 729 bp, Triticum aestivum
accccgccagccatgggaactgcctgtgatccagacagaaggagaatcaagtgatgagcttcgtggacggcgagatcctcaaccgctcccggcgcccacccctctccaagggcgccctcgcacgcgtctccggctcctccgacgccgacgacgcgctccgccgcagaagcaaggcctcgacgcccgggcggcggcatggcgcagctgcaccacctgttcgcctccgacgccaaggcgcctaccgccgcggcggctgacccggagggcgccgtcgtgagggtgaagctggtcatcagcaagcaggagctgaggaggatgctgggcaaggacgacgatgccgtctccatggatgacatggtggccctcttgcgaagagggtcggaggatcaaaagcaggaggacgttggttgctacagagggtggcggcctgccttgcatagcatacctgaaggcagcggtgatctatattctatgttagcataagaaattagctggaagaaaatacatatatggatactaagcataagaaaatatgcatgtgtatatgtatatgtatatgtatttgtattcacatagtagaaaatagagatcatagttgggtagatctgctgctagtagttttgagatgggggttatcttcaggttgtcttgttataggtgggtgctgggtgcatacatccatgtaagacaaggtaaagatagtcctggaaaccaaacgagacaatacaa

SEQ ID NO: 1194 - DNA, 866 bp, Triticum aestivum
ggggaacgcgcggtacgcgacgcacatcgcccggagccacatcatcccgccggtgttcgcgctggtgcacccgaagaccggcacgcccattcacgccacggcgctcatcaccggcgccagcgcctgcgtcgcgttcttctccagcctcgacgtgctcgccagcctcctctccatcagcacgctcttcatcttcgtcatgatagccaccgcgctccttgtccgccggtaccacgcgaggggcgtgacgagccgggcgcacgggcggctactcgcggcactcgtgctggcgatcgtcgggtcgtcgggtggcatcgcggcgtgctggggcacggcgccggagcggtggacaggctacgccgtgctggtgccggcgtgggcggcggcgacgctcggggtgcagctgctggtgccggtggcccgcgtgcccacgaagtggggcgtgccgctcgtgccgtggctgccttcgctctccatcgccaccaacatcttcctcatgggctccctgggcgcgcaggcgttcgtccgcttcggcgtctgcaccgccgtcatgttgctctactacgtgctcgtcggcctgcacgccacgtacgacgtcgcgcacgaggaggtggacgacgctgcggctgatgagaaggcggcggctgccgccgacgtggagaaggctggcgccggagatgctgagcgctaagatgtggctggatttggtccgtctcgatctggctcgccatgattgagaatgtagataaacatagtactgtttgacaacgaagttgcaaaaattgcagcaaaataagtaagtggcagctatgtcgtggcattttcattagcactttacctatatgtcagtcaactggattttaaatttg

SEQ ID NO: 1195 - DNA, 458 bp, Triticum aestivum
cggggaggcggagcgcggcgtcattgaagacggcggcgaggagctggcgtcgacggcagcgacgccggggacaatgttttgccctgacctggaggttgacagctggctcgggttccggttccacgacctcgactttggctgcgggccgccctgcgcgttcctaccgccggacctgcctatcgaaggaataatgatcttcgtgccgtcctgcgacgccaagggcggtgtcgacctcttcatggcgctcgatgacgaccacgtcgaggccttcaagcagatatgctactccatggactaagcatgcagcatacacttatatatagatatgtgccggagtaacaccacaaaaatgtatactagtactatatatctaccccaaaacagcctttgcttaattagttaaccggaaatgtaaaaataaatctgatatcagatttttaagcagaatgaatcagacg

SEQ ID NO: 1196 - DNA, 616 bp, Triticum aestivum
tggctccgtgttcctgctttcgccggcgccaaggacgacgcgcgttgccgccgtgccgtgccgctgtggtggcgttcgtctgcaccttctccgtcgggttcgggcctatggcatgggtgtacagctcggagatcctccctctgcggctgcgcggacagggcgccgggctcggcaccgccatgaaccgcgtgatgagcggcatcgtcaccatgaccttcatctcgctctacggggccatcaccatggccggcgcattctacctttatgccgccgtcgcggctgcctcgttcgtgttcatctacacctgcctgccggagaccaggggccggaacctcgaggacatggagcagcttttccgcacaaaatgatcaatccaccgacccgtggtcacattgataattgtcaacttgtgattggaaatagggcggataggatggcccacagagtaaagtattccctccggtcctttttactctgcacgttagatttcctgaaaatcaaattttgctaagtatatcataatgataaattagtagagtttttaggtatcttgcggtatatcataagtttgggtcttgttatacatatgataatacagacaatattattggcatcc

SEQ ID NO: 1197 - DNA, 701 bp, Triticum aestivum
gtacatgccccgagttcgtgatggagggcgtgttctcggtgaagtccgacgtgttcagcttcggggtcctgctgatcgagatcctcgcggcaaagcggaacggcgcgctctacctcgaggagcacgacagacgctcatccaagacgcatggaagagctggactgaggagaaggcggccgagttcatggacccggcgctggggcgggcctactccaaggaggaggcgtggcggtgcttccacgtggggctcctctgcgtgcaggacgacccggagctccgcccgaccatgtccagcgtcctgctcatgctcatcagcgaccacatgaacctccccgcgccggccaggccgcccatgttcaccaggctgaggaccttcccggcggcgatgatccccttctccaccaagaccgagtccaccttctcgccccagtccatcaacgacgtctccatcaccgtcgtcgagccgcgatgaggttgatggtgctcttttgttgttgtgtacatactgctagctgaaatgttcttcgagaaggccggccgccgttggatttttgtagttatggtgacagtgcgtacacactgtggcacaagcttcgtgcagatggtgacaagtgagatccatggcgaattgagtacacgtgattggttttttccctttgattaattcctatgtcaagaaaagaaaagaactcactggcata

SEQ ID NO: 1198 - DNA, 857 bp, Triticum aestivum
ggaaatgctacgccaccaggctgtgcagcttgttgcacagcgcctggggcgcatggaaccaccagttcgcagggaagttgttgagttcatgtcagacgcacgctctcacctgtggagcatgcgacgaagcaaagcaaacttcttccgtctgatgcaagtcttctctggattcattgctgcagggaagtggtttggtgacgtttgccagtggaaaaacccagtcaccacagtcttggtccatgtactcttcatcatgctcgtcttctatccagaccttatccttccgacgatcttcctctacatgttcttgattgggttgtggaattatcggttccggccacgtgtcccaccacatatgaacacaaggatatcttatgcggatgttgcgcatccagacgagcttgatgaggaatttgacacgttcccaacctcgaagagcgctgacctgattaggatgaggtatgacaggctacgacacgttgcaggcaggatacagacagttgttggcgacatcgcaactcagggtgagagattgcagtcactgctgagctggagggacccaagagcaacagctatgttcttattattttgcctgttcactgcaattatactgtatattacaccatttcaagtgattgcgctctgccttgggttcttctggatgaggcacccacggtttcgccacaaggtgcccgcagcgccagtaaacttcttcaggaggctacctgcaaagacagactcattgctgtaaaggtccttggacatgagctaccaatgttatgtcacagttctttgtatctatttactatgtaatactgttgtacaatggcattgggtaataatatctattgttgtac

SEQ ID NO: 1199 - DNA, 705 bp, Triticum aestivum
ccccgcgacgggtgccccgcttccgtggacaccatctgggcgcgttcccccggccgacctccaagtgccctggctcctcagcttccttcgccagatcggcctcaacgccgacgacctgtggcgcttccggcgcgcacacgctcgggatcgcgcactgcggctccttcgaggagcggctgtttcccaaggacgaccccaccatggacaagtttttcgccggccacctcaagctcacctgcccgcggctcaaggtggacaacttcaccgccaacgacatccgcacgcctgacgtgttcgacacaagttctacgtcgacctgctcaaccggcagggtctcttcacctccgaccaggacctgcacaccgacgccaagaccaagcccatggtcaccaggttcgccgtcgaccaggccgccttcttcgaccagttcgtcaagtccatggtgaaaatggggcagatcaacgtgctcactggcaaccagggtcagatccgcacggactgctccattcccaacgccgcccgcagtgccggcgacgagctgccgtggtccgtcgtcgagaccgccgtggagagcttggtgttgtaggtagtagtagggtttagtccatggatctcaagcttgttttatgttttggcaggtttggactttggaagtcagagtgcatgcgtgtttagtttgttgagcaagaccgaaccagttgaata

SEQ ID NO: 1200 - DNA, 707 bp, Triticum aestivum
gtgagcatcagcaaattcgtgctgggtattgctccataacatcttcagcaaacattatgatccccggaacaatatgtagtctttacttgctggagcactttttggggtgattaaagggggcgttttggtcgtcttcactgccacagctggggcatcatcttgctattttctctccaagttgattggcagacctttggtttgctggttgtggcctgaaagactgagatatttccagtcagagattgcaaagaggaaagacaagctgttgaactacatgctttttctgagaataacaccaactttgcccaatactttcataaatatggcgtcacctattgtcgacatacctttccatattttctttgctgcaacactaattggactcatcccagcatcttatattactgtaaaggctgggagagctctaggcgatctaagatcagttagggaattgtacgacttcaagacattagttgttctgttcctcattggatctgtcgtcgtcgtcccaaccatcctgaaaaggaagagaacatacgagtgatgcctcaggcgagacatctacatatacagtccccgatgccccagcgtgtactagcctctcttttttcgccttttctttttccttccctatatatgtatacctatttaatttagctgtaaagatgtaagaaacggaatggctcccttaaaagtcggtattacgc

SEQ ID NO: 1201 - DNA, 709 bp, Triticum aestivum
gctggtgattccgaagcaagcacgcctgagaagcacttcccgctgcagctcccggccgcgggcggcgagaagcaaggggcctgctcctgaacttcgaggacgccgccggcaaggtgtggcggttccgctactcgtactggaacagcagccagagctacgtgctcaccaagggctggagccgcttcgtgaaggagaagggcctcggcgccggagacgtcgtcgggttctaccgcgcagccgccggcgaggacagcaagctcttcatagactgcaagcagcggccgagcaccaacagccctgcccccgcagaccccgtggaccagccggcggtgcccgtgaagaaggccgtgagactcttcggcgtcgaccttctcacggcgccggcgtcgccggagcaggggatgccggggtgcaagagggccagagacttggtgaagtcgccgcctccgacagcggcgttcaagaagcaatgcatagagctggcgctagcgtagagttggaactattagctcgatcgatctcttctctccagctaggcggcggtttttgctcgcgtaattcaggtggtagagcttagcttaattagtcccttgttggtactatcatcaactttgtttgtttatttgtcatgttgttgcatgccctgatgtaaatcttatcctcccaaaaatgtatactaattgaggaagccctagaaggctagcctaga

SEQ ID NO: 1202 - DNA, 863 bp, Triticum aestivum
ggttaaacatgtggacagcccgcaattgagcttctggagcttgtttcctgctactcccgtttgaacgcatttcatatacaaagctgtggagatcttagaaggtgtagataagaagtttgagaacaaggttgaatggggaattgatttagcatctgagcatgagaggtatttgactgaggtgatatttaagaagccagttattgtgtataactacccaaaaggaataaaggcattttacatgaggctcaatgatgaccagaagacagtagctgcaatggatgttcttgttcccaaggttggtgaattaatcggtggaagccaaagggaggagcgtcttgatattcttaagcaaaggatactggacgcggatcttcctctggagccatatgagtggtacctggacctccgacgctttggctcagtgaagcacagcgggttcggcctagggttcgagaggatgatccttttcgccaccggcctggagaacatcagagatgtcatcccattcccaagataccctgggagggccgatctttgaagggctgcagatgtctgccttgagatataagaacgtcaattctacactttgttagcgattttgaagaagtgttggccgtccggttagattgatatatatacgcatgctgatatcatttgatatgtctcgtgtcttggcttgttgtgattcttaaaaaaagtatcaggcttgttttaagattagaacgttgaagtattattggtccttagcatcttctttttgtaaatttaatttgatatcctgtttggatcctatgtctgcaaacttcgagctgttttgaagatgtcttggttagatgggggaagaatgttaaattgtgtcacct

SEQ ID NO: 1203 - DNA, 518 bp, Triticum aestivum
agaggctcagcatcaggggccgcgtctacccggcgatcctgcccgtcgacggcagcaaagtccccgggaaggtttggaaggggatcactgacagggagctcgatgtgctggacatctttgaggatgaggagtatgtcagggaaactgttggcatctcgctgaccgattcggcggacacaatgatcgcctacgcatacatatgggggaatgtggatgatcctgacctctatggtgaatgggattttgatgaatggaagaaagtgcatctgaaggactatctcacaatgacacaagatttcaaggaggaactggaacagcttgaatctgagacacatgattgaagcttgccaatcattcttccagaaggattaattcgccaatttattgtatgtgctttgttcaaccagctctaatgtgaattgtaaataagatattcatcggattgccatcaacctagcaaaaaagaaaatagttttcatatcttgtgacgaccatagactcgagagtgttcaagtcta

SEQ ID NO: 1204 - DNA, 745 bp, Triticum aestivum
ttttaaataagcttaaactcttaggtttaacctgttaggcgacagctggtttatgtaaatatatatatatcactttggtaatacaaactcagtataagataatgcaaacggccgctcttctaaaagctagagatgacactgtcagcatcaagaaacaactgagaaacttcagctcaggtgttgcgagtcatgcccctgagaatgatggtcttccagagggcacttgcaatgtttctgcagctccaggtacttctccatgttgaaaccatgcttcacgcaaagctttctcctcctcgactcaaacatcctctccatgaagtcttgatacgtcgggtcccttgaggtgatgacgaagtaggcatagccaaccagcagccccgaggtggtcgtgaagaaggcgatcggctccatcacgtcccatgagaactcccagaacgtgagacggaagaagatcccaacctggatcatgaagaaccctaagccagtccacaggactcgccggacttgcttgtgtgccagcttgtcgatctcttccttcttttcctggagctgcttaaactcttcctttctcgtgtcgttgtctggtgcgagtgcaagcggcaccgcccttctgaccaggtccacaaccttctcggggtggaggtacgccttgtcccgaaagagaagcacgacgccagcgtcatccatggcccgggccagcacctccgcctcgccgcgcgtgcgggccgcgccgacctcgacgcag

SEQ ID NO: 1205 - DNA, 517 bp, Triticum aestivum
aggcagagcgacgagtgcgttggacaggaggacgaccttcctgtgggagctcctctcggagtccttcgcggcgctcgtgtcgcaggggctggtggagcaggacaaggtggacgcgtacaacgtgccgttctacgcgccgtcgctgcaggagatggaggtggaggtgcggctggaggggtccttcagcctcgactacgtgcagacgtacgagatcaacctgagcagcagcggcgacgccaaggaggacggcaggacggtgtccatggcgatcagggccatccaggagtccatgctcagccaccacttcggcccggacatcgtcgacgcgctcttccacaagtacacgcagctggtcaccgagtccatggagagggaagaggtcaagagtgtccagataggggtagtcctcaccaggttgtgactcgagtctgtctactgactgtatttttctttagcaagtttaggtttgactctgttctattgtcatattcagtattgtttagtagtagataattgg

SEQ ID NO: 1206 - DNA, 681 bp, Triticum aestivum
aaggggttattccagctctattatggtcaccaatcccgcaattcagttcatgctgtacgagactcttcttaagaagctgaagaagagacgtgcctctaaattttaagggggctcaaggactgactgctattgaagtttttcttctcggagctgttgcaaaactgggtgcaactcttgttacatatcctcttctagttgtgaaggcaagacttcaagcgaagcagatgattgatgatgacaagaggcatcgctacaaaggcacatttgatgcaatcacaaaaatgatgcattatgaaggcctatcagggctttataaaggaatgggcacaaaaattgtacagagtgtttttgcttctgctctcctttttatgatcaaggaggagctggtgaaaggtgctcgattcttggtaaccggtgacaccagcctggttaagaagttgccttcaaagccgtcaagatgatctaggtctgcgcagaagtgttagttgctgattatatatcataaattgcaaacagagtaggcaaaaagagctcgcctctgaggcatcaggttacagatggtagacacaatgggtatgtaaacttgagattatacggtgaccactatgattctcgtaggtactgggataaattacacattggataggatatttaagccactcatgtaatgtaaaatatatt

SEQ ID NO: 1207 - DNA, 1442 bp, Triticum aestivum
gcgatctcccccaccccctctgctctcgcccttgccgtggcgaggcgcccgctccaaaatggcggaggtggaagacgtcagcaacaggatggaagcgcactgcgcgtccaccgcggcggaggacgacgccgatctcccgctccccgccctctttgacagagcgtcccactctccactcgctcgcctccagctcctccctcgaccaggaagggatccggaagggggtcgacctgctgcggcgctgcgacgacatggtcagcaagctcggcctcttctcctccaacgagaccaaggaagacgtctccaccgccaatctcaagtacctgctcgtgccgtactaccttggggaaatgactgagcaagtggagcaggaggaccggattccggtcctcaaggcatcgcaggaccatttgaaggagttcatttctgtatgtgaagcattggagcttattccagaggacgagcttcaatagtataggcaggggcagtctgaaacaggggcaaaccgaagagcacaaaaggttgccaggttcaagcggcaaaaggctgcagaaacgaagctccaagagatcaaagagagaaaggaaaggcgcgggcgttcattgagagcaacggctttatcagcacctattgaagccggggaagaagatgatttggaggccgatggagaggaagaaagggaggcttggcttgctactatctccttggctctctgcaaggcttttgatctcgttgacatgttaaagaaggaagaagagatgcttctggctgtaaaagaaagaaaaagaaaaggatggaaatgcatttgctcgagaaatgctagatgagcgcaggcaaaaggctgaagcatggcaccagaatgctgccagccgtgcaccatattccaaaccagctgctccaatcacttgtgcaacttttgctcaagacgtcattgaaggcagagcaagtgtttcacaagctcatgaccacaaacaccaacccctgatatttggacctgcaagtcttgttggtgggggactcaccagtgagagggaaagaatggcagcacaagtttttcagcctagtttcaggatgccgacaatgagcatcgaacaagctggcttagcggaaatgaaaatgatggagcaatggcaagaaaggactgccaagatgattcaagaggcaagctcctcttggcacaaggatgacaatagtttggcgcaggacgacgaggacgcagaagaggagaaagcaagggcatttgatgactggaaggatgaaaacccacgcggtgcaggcaacaagaagctcactccctgcggctaaattgaaagctattgacactgtgctgaagataccacatgtagctgatgttcatgtactattataacgtttctgttatttgccctcacgtttgcaagagtgatcaccagagtacattatttgcagaaatgttgtgcgag

SEQ ID NO: 1208 - DNA, 645 bp, Zea mays
atgggcggcgacggcacgagggcgctggaccagacgccgacgtgggccgtggccgccgtctgcgctgtcatcgtcgcggcgtccatactcctcgagggcttcctccaccacctcggtcagttgctcaacaagaagcggaagaaggcgctgtttgacgctctggagaaggttaaatcggagctgatgactctggggttcatatcgctgctgctgaccgtgacgggaaggtacatcgcgcgcatctgcatcccggagggagccgcaaacaccatgctgccctgccgcctgtccggtcactcggtggcggaagagcccaagggccatggccgacggcacctatctgaagatccaaccaaccttttttcctgccgcaaaggcatggtgtcgcttgtttcagccgacggcatgcatcagctgcacattttcgtgttcttcttggccgtcttccatgttaccttcagtttcttcacaatgtccttgggtagagcaaagactcgtatatggaaggtgtgggaaaaggaaacttgctcccctcagtataattatttaaatgacccctcaaagttcaggcttacgcaccaaacatcttttgtgaggcaacatgcaagttgttggagcaaaagcacaattcacgctctatttttg

SEQ ID NO: 1209 - DNA, 354 bp, Zea mays
  misc_feature (288)..(289): n = any nucleotide
  misc_feature (335)..(336): n = any nucleotide
  misc_feature (354)..(354): n = any nucleotide
atggtcatggacgtggcgcgctggcggcggggagggtacacccggcgggtggaggagtggatggcggtgcaaaagcggaagcggatctaccacctggggtcgctgcctccgttcctgctggtgctcgccggcgacatcaggcccgtggaccaccgctggaaccagcacggcctgggcggcgacaacgtcgagggcaggtgccgggagctgcacccgggccccatcagcctgctgcactggagcggcaagggcaagccctggctgcggctcgactcccggaagccctgnncacgtcgactactctggggcgcctacgacctctacaaggccgcggnncacgcgctggaggagtan

SEQ ID NO: 1210 - DNA, 564 bp, Zea mays
atgagccccaagaccaccgacttcggcctcgccaagatcttggaggacgaccccgacgcgcctaacacggcccgcctcgtcgggacctacgggtacatggcgcccgagttcgcgctggacggcgtcttctcggtgaagtcggacgtgttcagtttcggggtcctcctgctggagatcttgagcgggcaacggaacggcgccttgtacctcgaggaacaccagcagtccctcatccaagacgcatggaagctgtggagtgaagaccgcgcggccgagttcatggaccagtcgctggggcggtcctactccaaggacgaggcgtggcggtgctaccacgtcggcctgctctgcgtgcaggaggaccccgacgtccgcccgaccatgtccaacgtcctgctcatgctcatcagcgaccacaccaagttacccgagccagccatgccgcccttgttcgcgcggctcaggaacatctccttgctggcgccgccactcaccaccaaaaccgagtccaccacgtctccgctgtcgatcaacgacgtctccatcaccatgatcgaaccgcga

SEQ ID NO: 1211 - DNA, 816 bp, Zea mays
atggatccatacaagcaccgcccgtctagtgggagcaactccagcttctggaccaccaactccggcgcccccgtctggaacaacaactctgccctcaccgtcggacagcgaggtccaatcctccttgaggattatcatctaatcgaaaagcttgctcagttcgacagagaacgtatccctgaacgtgttgtgcatgcacggggagccagtgccaagggtttctttgaggtcactcatgatgtctctcaccttacatgtgctgattttctccgtgctcctggggtccagacacctgttattgtccgtttctctacagttgtgcatgagcgtggaagccctgagaccttgagggatccacgtggttttgctgtcaagttctacaccagagagggtaactttgacctcgtgggtaacaacatgcctgtgtttttcatacgagatgggatgaaattccctgacatggtccacgctttcaagccgaatccaaagaccaatttgcaggagaactggagaaaaatagatttcttctctcaccacccagagagcctacacatgttcaccttcctctttgacgatgttggcatcccactcaactacaggcacatggagggctttggtggcaatacctacaccttgatcaacagggatggaaaagcctccccttgtgaaaattcctttggaagcctacttgggggatgtgaaaaggtttgctcgaacaatgaaacttgtgaactggttggaaggaaccttgcccacagcccatgggaagaaaggaacttttttggaattccttcggaggctggtggaatttacccc

SEQ ID NO: 1212 - DNA, 753 bp, Zea mays
atggagtccggcctcgttgcaagccaccgcctccgcgtcccgcccccctccgcctccgccgggcaccaccacctcatccgccaccgccacgcccacgccccggtggccgctgcgcccctccgcctcagtctcccgcgccacctcccccggtccaccccgctccgcctgcccgccgcgctcccgctccgccactgcctcccgcccctccgcgccgcctccgccgccgccgccgcagtcccagcgcccggggacgacgcgtcgcccaagttcctgggcgtggagacgaagacaatcaagaagatcgtgcccctggggctcatgttcttctgcatcctcttcaactacaccatcctgcgggataccaaggacgtgctcgtcgtcaccgccaagggcagcagcgccgagatcatcccgttcctcaagacctgggtcaacctgcccatggcagtcggcttcatgctcctctacaccaagctcgccgatgtcctctccaaggaggcgctcttctacgccgtcatcttcccgttcatcgccttcttcggcgccttcgcctacgtgctctacccatgcgcgacgccatccaccccactgcgctcgccgatcgcctcctcgcctcgctcgggccagctttctcggacccgttgccatcctccgcgtctggagcttctgcctcctctacgtcatggccgaactctggggcagtgtcgtcatatccgtccttttctgggggtttgccaatccgattactaccgt

SEQ ID NO: 1213 - DNA, 342 bp, Zea mays
atggtcaatattattcttggtggttatgataaggatgttggtgcttccctctactacatcgactacattgcaaccttgcacaaaattgacaaaggtgcttttgggtacggatcatacttctgtttgtctcttatggacaagttgtaccacccggacatgactgttgaggaagcagtagatcttgttgacaagtgcatcaaggagattcggctgcgattggttgtcgcgcctcagaactttgttatcaagattgttgacaaggacggggcgagggagtacgccaggcgtgaactcgtcggtgacaatgcacctgctgaagctgcaaccgcagttgttgctgcc

SEQ ID NO: 1214 - DNA, 336 bp, Zea mays
atggtgcatctatgcagtggtgagcagcagcaacagcatcttgctgaagcacaggagcagggcatcgtgtctttgctggaggagctagcagaaagtggcacggacagaggaaagaggaaagctgtgcagctgctcgaacgaatgaatcggttcctaaagcagcagagtcaagccgaagccgaagcagaggccatggcacaggctcatgcacaagcacaagcacaagcacaagcacaagcacaagcgcagcctcagatcctggttcaagctcaagcacatgcagatatgcaagctgaacgatcactacttcccacatcatctgacatttcggataga

SEQ ID NO: 1215 - DNA, 507 bp, Zea mays
  misc_feature (358)..(358): n = any nucleotide
  misc_feature (402)..(402): n = any nucleotide
atgcatatggttttgagaaaccatctgcaattcagcagagaggaattgttcccttctgcaaggggcttgatgtcattcagcaagcacaatctggtacaggaaagacagcaaccttctgttctgggatcttgcagcagcttgactatggtctggttgaatgccaggccctggttcttgctcccacccgtgagcttgcacagcaaattgagaaagttatgcgcgcacttggtgactaccttggtgttaaagtccatgcatgcgttggaggaacatctgttcgtgaggaccaaaggattctcgccagtggtgtgcatgttgttgttggtacacctggtcgtgtgtttgacatgctgcgtanacagtccctccgcccctgatacatcaagatgtttgttcttgacnaagctgatgaaatgctttctcgtggtttcagggatcagatttatgacatcttccagcttctgccatccaggattcaggttggagtcttctctgctacaggccacc

SEQ ID NO: 1216 - DNA, 708 bp, Zea mays
atggcgcgcgggggagacggcctgcaggtgctgagcgcgctggacgcggcgaagacgcagtggtaccacttcacggccatcatcgtcgccggcatgggcttcttcacggacgcctacgacctcttctgcatctccctcgtcaccaagctgctgggccgcatctactacacggacaccagcaaggacagccccgggtcgctgccgcccaacgtcgcggcggcggtcaacggcgtggccttctgcggcacgctggcggggcagctcttcttcggctggctgggcgacaagctggggcgcaagagcgtgtacgggatgacgctcatggtcatggtcatctgctccgtcgcgtcgggcctctcgttcggccacacccccacgggggtcatggccacgctctgcttcttccgcttctggctcggcttcggcatcggcggcgactacccgctgtcggccaccatcatgtccgagtacgccaacaagaggacccgcgggcgcttcatcgccggcgtcttcgccatgcagggcttcggcatccctccccgggcggcatcgtcacgctcgtcatctcccccgccttccgcgcgggggacccgttcccggcggacaagggacgaacaactttacctccaccgggggcggaaggccgaacactcctggggcggggtcattcagctatggtcttgcggccgcggccggcgcctgcttacc

SEQ ID NO: 1217 - DNA, 780 bp, Zea mays
atggcaataacaccaaggctcgccgcaatcttcttctccttgctctgctgccgctcagcgtcctccttgcgccctccgaatctcatctccaacagcagcggcggcgtcatcacccatctccctggcttccaggggcccctccccttccacctccaaacagggtacgtggaagtggacgaggacaatggcgtccacctcttctactacttcgtccggtcggagcgggaggacagccccggcgacgaccccgtcgtgctctggctcacgggcggccctggatgctctgtcctcaccggcctcgcctacgagatcggccctctcagtttcgatcttaacggctacgttggtggcttacccaagttggtgtataaacaagattcatggaccaaggtgagcaatgtcatatttcttgattctccggttggcgctggattttcgtattctcacacggaggaaggctacaaatcgagtgataccagagctgtgaaccaaatcctcgtcttcctcaaaaagtggtttgataagtatccacagttcttttcaagtcctctctacatcgccggcgattcctactctggcatgatcgtgccaaccgttacatctgaaattgctagaggtaaagaagaggggagccaaccgaatctaaatctaaagggctacctcgttggtaatccagtcacagatttcaacttcgatggtccgtccagaatccatttgctcacgggatgggtctcatatcggacgaatatacgaggcatacgagaagagctgcagtgtggg

SEQ ID NO: 1218 - DNA, 588 bp, Zea mays
  misc_feature (355)..(355): n = any nucleotide
atgggggagcgggacgcccgccacacgatttcatggagcactgcctgcccacctgggccgcaaccaacaaccgtgggtatctttccccaggccacgcggggtgggtacttccctccacagcctggtccccgggcgaagggcccttggaggagccccgaggcccgggagaacctgcagcgcctgtggcaggaagtaccgcgtcgacatcgcctttttcgcccacgtccacaaatacgagcggacctgccccatgtaccagagccagtgcatgcccagcgagaagacccactactcagggaccatgaacggcaccatttttgtcgtcgccggcggcggcggctgccacctgtccagntacaccacggccatccccaagtggagcatctaccgcgactacgacttcggcttcgtcaagctcacggccttcaaccactcgtcgttgctgttcgagtacaagaagagcagcgacagcaaggtctacgactccttcaccatcgacagggactaccgcgacgtgctcagatgcgtgcacgacagctgcttccccaccacgctcgccacctagttaataaaactaccacttattgg

SEQ ID NO: 1219 - DNA, 279 bp, Zea mays
  misc_feature (185)..(185): n = any nucleotide
  misc_feature (278)..(278): n = any nucleotide
atgacgccgcagccgcccaagccgtcctgccacgacgtcatcacgggccagtgggcgccctcgcccgccgacgtggccgcagggaggctgccggggtatggcgtcctcaccaacatcatcaacggcggcctcgagtgcggccatggcgccgacgctcgtgttgccagccggatcggcttctacanacgctactgcgacatgtttggtctcagctacggcgacaacttggactgctacgaccagagccccttcgggaacacagtcttaagcaccaccant

SEQ ID NO: 1220 - DNA, 309 bp, Zea mays
atggccgacaacaccgggacgttggcgggcggcatcaaggacgtgccggggaacgagaacgaccttcacctccaggaactcgcccgcttcgccgtcgatgagcacaacaagaaggccaatgctcttctggggttcgagaagcttgtgaaggccaagacacaagtggttgctggcacgatgtactatctcactattgaagtgaaggatggcgaagtgaagaagctctacgaagctaaggtctgggagaagccatgggagaacttcaaggagctgcaggaattcaagcctgttgaagagggtgctagcgcc

SEQ ID NO: 1221 - DNA, 330 bp, Zea mays
atgctggacaagttccttgccttggcgctgccggagggcgccaccaaggaccaccccttcacctgccccatgggcccgcaggcgccgccgctggagtccgtgcacctgccgccgctgcttgtgtccgtggccgagaacgacctcatccgcgacactaacctcgagtactgcaacgcgctgcgcgccgctggcaaggaggtggaggtgctcatcaaccacggcatgagccactccttctaccttaacaagtacgccgtcgacatggactcaaccaccggggaacgagcccgagagctcatcgatgccatcaagagcttcatctcacgccat

SEQ ID NO: 1222 - DNA, 270 bp, Zea mays
atgtcgtcgaactcggagttgaggatggtgtcgaactcgacggcgaacaggtggttggtggcgttgccgttggtggcggagctgacgaggcccatgaactggcccggaagcgcggaggtgaagttggtgctcttggcgaccacgaacgccatgccgtggctgctgaggtcctcgaacgcgccgatgatgccgatgacgaaggccgtggagaaggactccatcgctgccgccgtgccgtcgggcgccccgtggaaccgcagcggcgccggg

SEQ ID NO: 1223 - DNA, 597 bp, Zea mays
  misc_feature (551)..(552): n = any nucleotide
atgttggtgtggcagggacccggacgtgctgtcgtcgtcgtcgctgctgtgcgccgcgatgcagccgctgtctcgcgagcagctgcgccgcgccaccgcctcgtcgtcgccatggtggcgaaagctgctttgcgcggcggcggcggcggcggcggcgggggcaactgcggcggcactcgccggctggtgcgtccgtgggtcgatgccccgggcgatgagcttgcgcttgatgtgcgtgttccagtagttcttgatctcgttgtccgtccgccccggcagctgggcggcgatcagcgaccacttgtttccgaggacctggtggagcttgatgatgacgtcgtcctcctcctgggtgaagttgccgcgcttgaggtcggggcgcaggtagttgatccaccggaggcggcagctcttgccgcaacgcagcaggcccgcggccttggggagcgacctccagcagccttcgccgtgggccttgatgtaggcgacgagccgctggtcctcctccttggtccaggcgcccttgttcgtgtgcgccttctcgcagcacnnggcgacctccccatgctgctgtgctggcctgctgctctctctagc

SEQ ID NO: 1224 - DNA, 447 bp, Zea mays
atggcggaccagctcaccgacgagcagatcgcggagttcaaggaggccttcagcctcttcgataaggatggcgacggctgcatcactaccaaggagcttggaacggtgatgcgctcccttggccagaaccctaccgaggcagagctgcaggacatgatcaacgaggtcgatgcggatggcaatgggaccatcgacttcccggagttcctgaacctgatggcgaggaagatgaaggacacggactcagaggaggagctcaaggaggccttccgcgtcttcgacaaggaccagaacggtttcatctcggctgccgagctccgccatgtcatgaccaaccttggcgagaagctgaccgacgaggaggtcgacgagatgatccgtgaggccgacgtcgacggcgacggccagatcaactacgaggagttcgtcaaggttatgatggccaag

SEQ ID NO: 1225 - DNA, 432 bp, Zea mays
atgtcgaggaggaagaccagggagcccaaggaggagaacgttacccttggacccactgtccgtgaaggagagtttgtctttggtgttgctcacatctttgcatccttcaatgacaccttcattcatgtcactgatttgtctgggagggaaactttggttcggatcactggtggcatgaaggttaaggctgatcgtgatgagtcgtctccttatgctgctatgcttgctgctcaagatgttgcacagcgttgcaaggagctcggtatcaccgcgctgcacattaagcttcgtgcaactggaggcaacaagaccaagacccctggacctggtgctcagtctgctctcagggctcttgctcgttctgggatgaaaattggacgcattgaggatgttaccccggttcccactgacagcactcgcagaaagggtttg

SEQ ID NO: 1226 - DNA, 882 bp, Zea mays
atgcaggcaaagaagggtggaaaggctgtgattgttggaggtggttacatagggcttgagcttagcgctgccttgaaaatcaacaacttcgatgtgaccatggtgtaccctgaaccgtggtgcatgccccgtctcttcactgctggtattgctcatttctatgagggctactatgctaacaaaggaatcaaggttgtaaagggcacggttgctgttggtttcgacgctgatgccaacggagatgtcactacagtgaagttgaagaatggaagtgttctcgaagctgatattgttattgttggcgtcggcggcaggccattgacgcgtctcttcataggccaagctgctgacgagaaaggtggactcaagaccgatgcattcttcgaaacaagtgtagccggggtatacgcgatcggcgacgtggccaccttccctctgaagctctacaacgagcagaggagagttgagcacgtggaccacgcccggaagtccgccgagcaggcccgtgagggcaatcaaggccaaggagtccggcgaatcggtggccgaatacgactacctgccctacttctactcccggtcgttcgacttggcgtggcagttctacggcgacaacgtcggcgacgacgtgctgttcggcgacaacgacccggcctcggccaagcccaagttcggcagctactgggtgaaggacggcaaggtcgtcggcgtgtttctcgagggcgggtcggccgaggagaaccaggccatcgccagggtcgccagggcgcagccgccggtggccgacgtccaggcgctgaagcaggaggggatcgatttcgcttccaaaatctgagctcttggaaaggtgtaaaaaaaagaaacattggtaccagttttagc

SEQ ID NO: 1227 - DNA, 750 bp, Zea mays
atggagtctctgttcggccaatcgcagcggaggaggagggcgggcggcagcggcttcgaatcgctcaagcgtctgggtcacatctcacccgctgtgcagtcccacctcaaacatgtgtacctcaccctatgctccgcgctggccttctctgcactcggcgcgtacctccacatcctcctcaacgtcggaggcgccctcacgaccgtgggatgcgtggcctccatcgccttcctcatctccctgcccgcttcacgggaccaggagaggaaccgcttggcgctgctcatgtctgccgcgctccttcaaggcgcgtccgttggtccgctcgtcgaccttgttattgacttggattcgaggattctcgtcactgcgttcgtcgggaccgcagttgcttttgcatgcttctctggcgctgccatcatcgccaagcgcagggaatacctgtacctcggcggtctgctttcatctggcctctccattcttctctggctgcagtttgctacttcaatctttggccacaccagcgcgaccttcatgtttgagctctactttggcctcctggttttcctgggatatatggtgtttgacacccaggagatcatcgagagggcgcaccgtggggacatggactacatcaagcacgcgctgactctcttcaccgactttgttgcggttcttgttcgaatccttgtcatcatgatgaagaatgcacaggagaaatcccaagacgagaagaagaggaagaagcgg

SEQ ID NO: 1228 - DNA, 378 bp, Zea mays
atggcggcggcggcagtatacggcggcttcaaggggaagcttggcgtcgaggatgcccccgagctgcagctcaaccgcatccgcatcacactctcatccaagaacgtcaagaacttggagaaagtttgtgcggatttggtaaagggagccaaggacaagcatttgagggttaagggacctgtcaggatccctactaaggttctccacatcaccactcgcaagtccccttgcggtgaaggaacaaacacatgggatcggtttgagttccgcattcacaagagggtgattgacctaatcagctcccctgatgtggtgaagcagatcacctccatcacaattgagcccggtgttgaggttgaggtgaccattgccgacgtg

SEQ ID NO: 1229 - DNA, 390 bp, Zea mays
atgacacacacacacatgcttcacaagattcaaatacaaaatacaatcacaccacgtcgagggttgcatagatttagctcgacgtccttattcatctttgcactacacacatgcatgcataaacatgcatggcttggccataaacatgaacatagatacggctacctccaccatcccagaatgattgaaacgattgaaacagagacaagtgatgagcaacaaggcaatctagtttcctccacccccacctcctcctccagtaccaccaccaccaccgcctccaccgccgccacctccgccgccgccgcctcctcctcctcctcctccacctccacctccaccgccccctccacctccgagagactggtggagttgctgagcaagtatcct

SEQ ID NO: 1230 - DNA, 240 bp, Zea mays
  misc_feature (65)..(65): n = any nucleotide
atgccttatggacatggcaccgtaaccaggacgcatatgcagagaacagtgtgggagaccagatntacattgtacgacagcctgacaagtgccttctgcagccagctagtgcgtcgtctctcaattgatagccccattggaggatgcccttctctagtgagtagtaacagctccggtgggtccattacaaatggccagctctcctacaaaatgtttgtaattatgtgtgtagctttaatg

SEQ ID NO: 1231 - DNA, 660 bp, Zea mays
atgggggatgccaaggatttgaagcgtgagaagaaggtaaagaaagacaagaaggtgaagaaagagaagaagaaaaagaggaaggtggaggttgttgatgaagggaacaccaccgataagagtactgatgctcctgtagatgatcagcagatcggtgatggtgctgatggcattacatttgatgagacattaaagtccaatcttcagaagcagtttgagatggctgcagcagaagctggtatggtcaaagggggcagcagctcaagcgcttcaccagtgacaccagtcagtgggaaagtggcaacaaagaggaagcgctcaaagtctgccgataagctgtctgaagcttctgatgggggtgatggcagcgaaggtaatcttcttgcccaggatggagagaagagtggtaagaaggtgaggttctcgatgaagaataatttagtttggaaacctcacaatcctttgccaccgcagtgtttgaggctgccaccttcggctactccaaggggaagtgctctaaaaaagggcgtaaagccaggtcccataacaccgacaccattgaggaaggcgaagcctaaggcaaaatctgcaaagaaggtcttgaagaagcaaccttcatctgctgtgaagcgcttgcggaagttgcagagtttttcagca

SEQ ID NO: 1232 - DNA, 381 bp, Zea mays
atgaactttgagatagagtcaagatacatcaatgacttcaagaccctgctagacaaggatgagaggatcatcagacatctggttatgaaacgggatgaggcaattactgaagattgccctcccccaccagtatttcacactctgcgagctcaacaatattttgatgatgaatatgaagatgagggggaagaggaagaggatgaggatgctaggagtgagccaaagtctgccaattatgatgaggatgatgttgaagctgatgatgagcctgaaattatttatgtcgatgaagctgatgaggataattacgaagacactagaagaaggaacacaaagctaaaggtgaagaagtatacatcagagaaggtattgaggcagcat

SEQ ID NO: 1233 - DNA, 723 bp, Zea mays
atggacactcaactagttgcccggcacgagcggtggtatgctctgctcattcctgaagtagtcgtcggggtcaatctcagcctttgccaccgcaagtctctcgtaattgtccacgaagtacttttcgccccagaccttgccggcctcgtagctgctgatgttgtccacgccgacgacgttctcaccgaggtccaggtccctgtagttgaagtacgcctccctcgggttggagctcacgtgcggctccatgaacgcgtacaagtccctgacccactcgatatgcgccgccccatccccaccggcggaccagacgctcacgtactggatgttgtacagcacgccggcgcggtgcgggaacggcgtcgccggctccggcacggcgccgacctgcgcgccgtaggggtccaggatcatgagccccgcgctgggctgcgcgagcttgccgaagataccgtcccacgcgcgccgcgggatggcctgccggaccgtaatcgacgtaatcttgaagtaggtcctccagctggtgaccttacaacatcacggcccccacactaccgccccaccaaacccccacgcgaatctgcgccatccgtgatgaaacaaagtaccccccaaaaaagcaccctttcgaccaccgccgaaagcggcgccgaaaaaagacccgccaacagctcaaccccgaaatctcaaaacacgccttcagctaccgccccagcgcatatc

SEQ ID NO: 1234 - DNA, 711 bp, Zea mays
  misc_feature (694)..(694): n = any nucleotide
atgaccggcacggtgtccaagctggcggcgccccggcctgcggcgccaccgctccggccggcgtccctccgcgccgccgcaatcgccttcgccccctccccgcgccgggtccgcgtctccgtcgccgggcgggccaggatcccctccgtcattgcgatggcttctgccaaggaaggaaatggtgcaccgaccaagaaaacctcgcttcacgatctctacgagctccagggcctctccccgtggtatgacaacctctgccgacctgtcaccgacttgctgccccttatcgccagcggtgttcgtggagtcaccagcaaccctgcaattttccagaaggccatctcatcctccagcgcatatgatgatcagttcaagcagctcatttcgggcggaaaggacgcggagagcgcttactgggaacttgttataaaggatatccaagacgcgtgcagtctttttgagcctatctacgatgagaccgatggggctgatgggtatgtctccgtggaggtgtctcctaggttggcaaatgacactcaaggaactgttgaggccgcaaagtggttacacaaagtggtcaaccgccccaatgtctacataaagatccctgctaccgccgaatgtgttccttccatccgggaagttatcgctaatggcattagcgtcaacgtcacgcttattttctctattgcgnagatacgaggctgtgat

SEQ ID NO: 1235 - DNA, 651 bp, Zea mays
  misc_feature (7)..(7): n = any nucleotide
  misc_feature (22)..(22): n = any nucleotide
  misc_feature (39)..(39): n = any nucleotide
  misc_feature (110)..(110): n = any nucleotide
  misc_feature (160)..(160): n = any nucleotide
  misc_feature (334)..(334): n = any nucleotide
atgcttnggagggatcatttgnttggggaccctgaaccngccgtgcccgcctcagggagaccgggaggccgagattttggaaatcgccggccacttggcccgctccggcnccgccgccgagctgcccaagacccccgtcctgtgcaagcccaacgtcgangccatggaggaggcgctcaggatcgccaacgtcaacccgcacaaggcgatttcttcgacgacagcgtacgcaacatccaggccgggaagcagatcggccttcacacagtgctggtgggcaagtcgcagcgggtgaaaggcgcggaccacgcgctggagagcatccacaacgtcnagggaggcgctgccggggctgtgggaggaggccgagaaggcggaggacgtgctctacgccgagcgcgtcgccatggagacctcggtcaccgcgtaaacccctctctcgaatcctccggtgcaccgtcagcccaaccttctcgacatccaggaccgggacgatcgcataccactctctccccgagccagggctggtggtctcacgctggaactgaatccagccatggccgggccgagaatttccgacagcaagaaggggtgcagcatgtaaaggggggagcagatgatatcatgtttgggatgctcccacgatatgta

SEQ ID NO: 1236 - DNA, 651 bp, Zea mays
atggcggcgggataccgggcggaggacgactacgactacctcttcaaggttgtactgatcggcgactccggcgtcggcaagtccaatctgctctcacgcttcacgcgcaacgagttcagccttgagtccaagtccaccatcggcgtcgagttcgccacccgctctctccaggtcgacggcaaggttgtcaaggcccagatttgggacactgccggccaggaacgatatcgtgctattactagtgcgtattatcgaggtgctgttggggcgttgcttgtatatgacgtcactcgtcactcaacctttgagaacgttgagcgttggctgaaggagttgagggaccacacagatcccaatatagttgttatgctggttggcaacaaatctgatctccgccatcttgtagcagttcaaactgatgaaggaaaagcattcgcagagagggagtcattgtatttcatggagacctctgcactcgagtcgactaacgttgaaaatgcattcgcagaggtgttaactcagatctaccgtattgtgagcaagagagcagttgaagcaggcgaagatgcagcatctgggcctggcaagggcgagaagattaacataaaggatgatgtttcggcggtgaagaagggtggctgctgctctagc

SEQ ID NO: 1237 - DNA, 492 bp, Zea mays
atgccggcggggcacgggcttcggtcgcggacccgcgacctgttcgcgcggccgttccgcaagaagggttacatcccgctcaccacgtacctgcgcacctacaagatcggcgactacgtcgacgtcaaggtgaacggcgccgtgcacaagggcatgccgcacaagttctaccacggccgcaccggtcgcgtctggaacgtcaccaagcgcgccatcggcgttgagatcaacaagcaggttaatggccgcatcatcaggaagcgtatccatgtccgtgtggagcatgtgcagccctcccgttgcacagaggagttccgcttgaggaaagccaagaacgatcagctcaaggttgatgccaaggaccgtggcgaggtgatcagcaccaagaggcagcctgtgggacccaaacctggcttcatggttgagggtgctacacttgagaccgttactcctattccctatgatgtggtaaatgatctcaaggggggttac

SEQ ID NO: 1238 - DNA, 192 bp, Zea mays
atgctagcaaatgagccgtgcaggtccaagagcgtcaacgaccagtcgtcactgtcgccggcgcacgacagtcatggtgattacaatgatatcgctgaggaggacgaagacgagtgggaggacggcaggaggaagtttggggcggcagatacatttaagattcctgacgagattgacattgctcatttcagt

SEQ ID NO: 1239 - DNA, 321 bp, Zea mays
atggcaggcggcggagtgctgaagcacatcctgctggcaagcttcaaggaggaggtgacgcaggagcgcctggacgagctcatccgaggatacgccgcgctcgtcggcgtggtcccctccatgaaggcgttccactggggaactgatgtgagcatacaaaacatgcatcaagggttcacgcacgtcttcgagtccacgtttgaaagcacggaaggaatcaaggggtacattgagcaccctgcacacgtcgaattcgcaagtgtgttcttgcctgtgctggagaaggtcctcataatcgactacaaaccgacgtcggccaat

SEQ ID NO: 1240 - DNA, 162 bp, Zea mays
atgaaccgagggcccggcgccgatacctccgccagggtgccgtggccgggataccacgtgctcaacgactccgccgacgccgccaacttcaccgcgctcgacttcatccagggagacatctggctcaacgccacctcattcccctacacgctgggatttacg

SEQ ID NO: 1241 - DNA, 447 bp, Zea mays
atggcggaccagctcaccgacgaccagatcgccgagttcaaggaggccttcagcctcttcgacaaggacggcgacggttgcatcacaaccaaggagctcggaactgtcatgcgatcactgggtcagaacccaaccgaggctgagctccaggacatgatcaacgaggtcgatgcggacggcaacggcaccatcgacttcccggagttcctcaacctcatggcccgcaagatgaaggacaccgactccgaggaggagctcaaggaggcgttcagggtgttcgacaaggaccagaacggcttcatctctgcggcggagctccgccacgtgatgaccaacctcggcgagaagctgaccgacgaggaggtcgatgagatgatccgcgaggccgacgtcgatggtgatggccagatcaactacgaggagttcgtcaaggtcatgatggccaag

SEQ ID NO: 1242 - DNA, 711 bp, Zea mays
atggcgagcaccacagacaaccgcctcgacctcggcctcctcctcctcctcctcgtggccgccgccaccgtcgtcctcgccgtggccgcggccccggcgcatacaccgggaggcaatactgctacccctccgccgccgttccggacggtgtacgcgttcggcgactcgttcacggacacggggaacacgcggtcgacgacggggccctactcgttcggctacgtgtccagcccgccctacggcgccaccttcttccaccgctccaccaaccgctactccgacggccgcctggttgtcgacttcctggccgaggcgctggcgctgccgtcctacctcccgccctacctcgccgtgtccgtctccaacgccaacgccacggcggccggagccggcgtcaacttcgcggtggccggcgccacggccatcgagcacgacttcttcgcgcggaacaacctcagcatcgacgtcacgccgcagtccatcatgacgcagctgggctggttcgacgcgcacctgctccggtcctcctcctcctcctccgccgccgccgccggcgacgcgctcttctgggtgggcgagatcggcgccaacgactacgcctacaccagtcgtgcccgcgacaccatgccttccaatctcgtcccgcccatggcccgtccagagggtcaccgctttcgtcgagggcctgcctggagcgaggcgccaagtacg

SEQ ID NO: 1243 - DNA, 660 bp, Zea mays
atggatcgggttcgtggatccgcgttcctgctcggcgtcctgctcgcaggatccctgttcgcgttttcagttgctaaggaggagaccaagaagctcggcaccgtgatcggtatcgatctcggaaccacctactcctgtgtgggtgtgtacaagaacggacatgtcgagatcatcgccaatgaccagggtaaccgtatcacaccctcatgggttgccttcaccgatagcgagaggctcatcggtgaggctgccaagaaccaggcagctgtcaaccctgagaggaccatctttgacgtcaagcgtctcatcggaagaaagtttcaggataaggaagtccagagggacatgaaacttgtcccctacaagattattaacaaggatggcaagccatacattcaggtcaagatcaaggatggggagaacaaggtcttcagccctgaggagatcagtgccatgattcttggcaagatgaaggatactgctgaggcgtcccttggcaagaagatcaacgatgctgtcgtcactgtccctgcatacttcaatgatgcgcagaggcaggcaaccaaagatgcctgtgtcattggccgcctcaatgttggtaagatcactaatgacccaactgctgctgcttttgcctcatgtctgggacaaaaagggtgc

SEQ ID NO: 1244 - DNA, 606 bp, Zea mays
  misc_feature (499)..(499): n = any nucleotide
atggccggcggtggcatcgtgaacacgggcggtggcaaggactaccccggcaagctcaccctcttcgtgttgctcacctgcatcgtcgccgccaccggcggtctcatcttcggatatgacatcggtatctcaggcggcgtgacgtccatgaacccgttcctggagaagttcttcccggaggtgtaccggaagaagcaggaggccaagacgaaccagtactgcaagtacgacaaccagctgctgcagaccttcacctcctccctctacctggccgcgctggtcgcctccttcttcgccgccaccgtcacccgcgccgtcggccgcaagtggtccatgctcgtcggcggcctcaccttcctcgtcggcgccgccctcaacggcgccgcccagaacatcgccatgctcatcgtcggacgcatccttctcggagtcggcgtcgggttcgcaaatcagtccgtgcctgtgtacctgtcggagatggcgccggcgcgtctccggngcatgctcaacatcggcttccagctgatgatcaccatcggcatcctggctgcggagctcatcaactacggcaccaacaagatcaaggcccggttacgggttggcgcg

SEQ ID NO: 1245 - DNA, 261 bp, Zea mays
atgcaggcactgagcaacgaccggtacaagagcgtgctccaccgcgtgatcgtcaacagcgagagcgagcggatctcggtgccgacgttctactgcccgtccccggacgcggtgatcgcgccggccgacgcgctggtggacgacggccaccctctggcctaccgccccttcacttaccaggagtactacgacgcgttctggaacatgggcctccagtcggccagctgcctcgaccggtttaggcccggaggatcgttggag

SEQ ID NO: 1246 - DNA, 612 bp, Zea mays
atgggggcgtacaagtacgtctcggagttatggagaaggaagcaatccgacgtgatgcggttcgttcaacgcgtgcgctgttgggagtacaggcagcagccggccatcgttcgcctcacaaggcccacccgccccgacaaggtccgccgcctcggctttaaggccaagcaggggtatgttgtttaccgtgtacgtgtgaggcgtggtggcaggaagaggcctgtgccgaagggtattgtctatggcaagcccaagcaccagggtatcacccagctcaagtttcataggaacaagagatctgttgctgaggaacggtctggacgaaagcttggtggactcagggttttcaactgctactgggtgaatgaggatagtacctacaagtactttgagatcatcctggttgatgtgggccacactgccatccgcaacgacccaagaatcaactggctatgcaatcctgtgcccaagcattgtgagctccgtggtttcccctttgcaggcaaaaagttccgtggcctgggtggcaagggccccactccccccaaaaacaggccgtcgaggagggccacctggaagggcaaccagaccctgtccctccgccgctaccgt

SEQ ID NO: 1247 - DNA, 486 bp, Zea mays
atgttttcatcctaccaagcaggttctgttcccgttggactttatgcagtacagacggagaatgtatttccagagagacctgaccaacctgaatgtcagttctatatgaagaccggagactgtaagtttggttctgtatgcaagttccatcatcccagggagcgaataattcctactcccaattgtgcactaagtccattaggcctacctttgcgcccgggagaaccaatatgcagtttctataatcgctatggcatgtgcaagtttggtccaaattgcaaatttcatcatccgatgggaaaccctatgtatggccatgcttcatcaccgacaagtgaggcccaaacatctcggcgtatgctggcacatgtaccatcgcatccagaagtatcacctgacagtggctcgggaaggtctaggaggattgttcattcagattcccagcaaataccctctgttgaaaggatcaccgagagagaggcgtcc

SEQ ID NO: 1248 - DNA, 540 bp, Zea mays
atggatgcatacatacacaggaaggatctggctgagctctgttgctcagcaggcgacgaactggtagtcgacgttgaggtggcccatctggtagccctgcccgttggtgtcgatcttcttgaacaccgtctcgtagtccaggtccaggccgccgttgctgcactggtccacgatcctcgccatgatgacgcgcccgtcgcacggttcttcacccttatgcacttgccgcaggcggcctggcccttctgcccggcgggcccgcagaaggccgtccagccgtgcttctgccgccacgacagcggcttgtcggcgtcccacgtggcgcagtacgcgctcacgcggttcaggtcccacccgttctgcgccgggttgtacaggtggtacgtcgcccgcacgttcgacgcctgctgcgccgccgccatggccgccaccgcgcagagcacgcccgccaccgccagcgccgcccgtcctccggagaccatcatcgccgccgcagcagccatcgtcgttgcctcttttctttgccaaactaacgatata

SEQ ID NO: 1249 - DNA, 735 bp, Zea mays
  misc_feature (105)..(105): n = any nucleotide
atgagtggcaaaaccccggaggaccccgggcactcccccggcccgccctccggaggacctttgcccccggccggggattacggaggccaggggggtcaaccccgnccaacccgcaaaactagggtttcccgtgcgcgtccgatgccagggccccactatgaacgacgggtgccagtggagaaagtatgggcagaaggtcgccaagggcaacccgtgcccgagagcctactaccggtgcaccgtcgcgccgggctgcccggtgcgcaagcaggtgcagcgatgtctagaggacatgtcgatcctggtgacgacgtacgagggtacgcacaaccacccgctccccatcggcgccaccgccatggcctccaccacctccgccgcggccacattcatgctgctctccagcacgagctcctcctccgccacctccgaggtccgcggcggctcagcggcaccttcctacctcagccccccgtacctgctcaactccacctcccaccaccccgccgcttcgccgctgctcggcgcacaaccgtcgtcgtcaatgcccagcgcccctgctggcgtggccaatggcgtgcagcatctcaacatgttcgggcattcgtccatgctcgctcagcaggcgccacatttcagcagcaagtacccgtggtcatcggacccttcgcagtcgcagggcatcggtggtggtctgccagcaggaagcaagaggccgttttggagcaccggcgg

SEQ ID NO: 1250 - DNA, 774 bp, Zea mays
atggcccccaagcgaggtggcagggcgccggtgccggccaagaagaagacggataaagtgacgaaccctctattcgagaagaggccgaagcagttcggcatcggcggcgcgttgccgcccaagaaggacctgcaccggttcgtcaagtggcccaaggtcgtgcgtatccagcggcagcgccgcatcctcaagcagcgcctcaaggtaccaccggcgctcaaccagttcacccgcaccctcgacaagaacctcgctacgaacctgtttaagatgcttctcaagtaccggcctgaagacaaggctgccaagaaggagaggcttctgaagagggcccaagctgagaatgaaggaaaaactgttgagtcgaagaaaccaattgttgtgaagtatggccttaaccatgtgacttacctcattgagcagaacaaggctcagcttgttgtcatcgctcacgacgtggatccgatcgaacttgttgtgtggcttccagccctgtgcaggaagatggaggtcccttactgcattgttaaaggaaaggctcgccttggatcgattgttcacaagaagaatgcatcagtcttgtgtcttaccactgtcaagaacgaggataagcttgagttcagcaagattttggaggctattaaggcaaacttcaacgacaagttcgatgaggtcaggaagaagtggggaggtggcatcatgggatccaagtcgcaggccaagaccaaggcccgggaaaagctgctcgccaaggaggctgcgcagcggatgacc

SEQ ID NO: 1251 - DNA, 585 bp, Zea mays
atgtcaccgttcgacacgtactgcagcgtgattgcacgcgccgccgccgcccacgtgcacgcgcgcgccgggcccgtcgatcgtcttgtagctgttcaccagcagctcttcgttcagccggatggccatgtccgacgcgaacacgatccacagcgggccctcctggatggcggcgtgccggagcgtgccaggggacgggttcacggggtcgcggtccgacgggtccgtcaccacgtacaccggcccgcccttgccgcccagcgcgttgcgcccgaacccgatgccgcagtccgccagccgctgccggtcctgccgccagtccgtccccgcgcaccgccagcagtcgtcgattgggttgcccgtcaagcacccgccgccgccgccgccgccaccgccgccggactcctgcatccgccgccgcgacgttgccaccttgctgtgcaagtcggcgacgacggcagcggggtcggggagcgaggagttgaggagaggaaaggccgaggctttggcggcggctgccagcagcaggagggagagggcaatgccggcggatttgggagctcgggccatggttccttggcggat

SEQ ID NO: 1252 - DNA, 513 bp, Zea mays
atgctagagaccgacttccagaacctcccctacctacaggccgttgtcaaggaatcactccggctgcacccgccgacgccactcatgctcccgcacaaggccagctcgaacgtcaagatcggaggttacaacatccccaagggcgccaacgtgatggtgaacgtgtgggcggtggcgcgtgatcccaaggtctggagcaacccgctggagtacagaccggagcgcttcctggaggagaacatcgacatcaagggcagcgacttcagggtgctgccgttcggtgctggccggcgtgtgtgcccgggcgcgcagctcggcatcaacctcgtggcctccatgatcggacaccttctgcatcacttcgagtggtccctgccggagggcactagaccagaggacgtcaacatgatggagtcccccggtctcgtcacgttcatgggcacaccgctgcaagctgtcgtcaagccgcgcctggagaaggaggagctgtacaatagggtcccagttgagatg

SEQ ID NO: 1253 - DNA, 336 bp, Zea mays
atgatactaccccgcgagccatcatccgtgcgcgagctggacgtggaggtgacgctgacgaccgccgggggcacgggcacggcgaggggcgtggcgggcgcggaccagtggcggcgctgctggtcgcgggcgacgcagagctgcatgatcctctcggcggcgtcggcggcgtcgcggctgtcgtcgacgaggcgctggacgtcggccttggggaggcgcacgcgcaggcgcagggcgccgccgtcgccgacggacgacgacgccgccacgtcggacgccgaccgccgcgccagcatcaggctctccagccgctccccggccccggccacggcgccg

SEQ ID NO: 1254 - DNA, 738 bp, Zea mays
  misc_feature (50)..(50): n = any nucleotide
atggtgttactgtccggggtcccgggctcgttctacgggcggctgttccncaggacgagcgtgcacttcatctgctcctgctccagcctgcactggctctccagggtccctccggggctcttcgacgagacggacaacaggccggtgaacaaggggaagatgtacatctcgagcaccagccccgcggccgtgccgctggcctacctgaggcagttccggagagacttcggcgtgttcctcaggtcgcgcgcggccgaggtcgtccccggcggccggatggtcctcgccatgcttggccggcagaccgaaggctacgtcgaccggcggacgaccttcctctgggagctcctctccgagtcgttcgcggcgcttgtgtcgcaggggctggtcgaacaggagaaggtggacgcgtacaacgtgccgttctacgcgccgtcggtacgtgaggtggaggaggaggtgcggcgggagggctcgttccggctggaccacgtgcagacgtacgagatcaacctgagtagcagcggcgacgccaaggaggacggccggacggtgtccatggccatcagggccatccaggaatccatgctcagccaccacttcggcaccgacatcgtggacgcgctgttccacaggtacacggagctggtcaccgagtccatggagcgagaggacgtcaagagcgtgcagatcggggtggttctcacaaggttggacttgtcacccaccacaggactt

SEQ ID NO: 1255 - DNA, 789 bp, Zea mays
  misc_feature (743)..(743): n = any nucleotide
atggcgccggcgatggggctgaagcggcctgcggctgcggcggcggcggcgggagcgggggcagcagcagcgcagacggtcacgctgtccgcgccggccgtgcgggacgcggtgcgcgccgccgtgagggatgccgaggccaccgccccggccgccagggtcccggcgacggcggcagccacggcggagatcgctagggacggggtgctgtgcctggaggaggtcgacgggaggcggtggagctacgtggtcgacgccgccggcgccgcggtcaaggccaagggaagggcgtccgtcggcgcctccttcaaggtcgtcccgctccagtccccgctgccgcccgtcgaggaaataatgtcctttataagatcatatgttgtgcccgaaggctttccagatagtgtcacaccttcatatgttccatacatgacatggagagcattgaagcatttctttggtggagcaatgggtgtgtttacaacaagaaccttgctcaattctgttggagtctcccaaagcagggccgcatctggtgctgtggctatcaactggatactcaaggatgtgggctgggcgtgttggaaagatgtttttttgcccgccaagggcaagaaatttgattatgatctgaagcagcttcgcttttctggtgatctcctgatggagttaggagctgggatagaactacctactgcacttttcccacacgttttcctacctatgccagcactaccaaagttgantaaaatgttgctgcttgcccttccacctctactccactccaactta

SEQ ID NO: 1256 - DNA, 1107 bp, Zea mays
atgcaaggaggcaacatacagggcaaacagatcggcgtgtccatggacaacggccgacctcgccgtcggcaacatcggcaagctcatgttcgcccagttctccgagctggtcaacgagttctacaacaacgggctgacctccaacctggcgggcagccgcaacccgagcctggactacgggttcaagggcaccgagatcgccatggcgtcctactgctccgagctccagtacctggccaaccccatcaccaaccacgtccagagcgcggagcagcacaaccaggacgtgaactccctcggcctcgtctccgccaggaagaccgccgaggcggtggacatcctcaagctcatgtcgtccacgtacatggtcgcgctgtgccaggccgtggacctgcgccacctcgaggagaacctcaagagcgccgtcaagagctgcgtgatggcggtggccaggaaggtgctgaccaccagcctcggcggcgacctccacagcgcgcgcttcagcgagaaggccctgctcaccgccatcgaccgcgaggcggtgtacgggtactacgacgacccctgcagcgccaactcgcccctgatgaagaagatccgggccgtgctggtggaccacgccctcgccagcggcgaggccgagaaggacgccagcgcgtccgtgttctccaagatcaacaggttcgaggaggagctgcgcgaggcgctgcccagggagatggaggccgcccgcgtggccttcgagaccggcgccgcgccgatcgccaacaggatcaaggagagccggtcgtacccgctgtaccgcttcatccgccaggacctcggcgccgtgtacctgaccggcgagaagctcaagtcccccggcgaggagtgcaacaaggtgttcctggccctcagcgagggcaagctcatcgaccccatgctcgactgcctcaaggagtgggacggcaagcccctgcccatctgctgaggagtgaggaggaggacgccaccggtgccaagaggcaagacccgcaagaggaggagatgacaccgtacgcgcgcgaggaagaaataaagaagggagtatttcggtattctcaagcaggcttcatatcgtttgcgatc

SEQ ID NO: 1257 - DNA, 1071 bp, Zea mays
  misc_feature (600)..(600): n = any nucleotide
atggagtggtacaccaccaatcctgattactggggagatgtcactggtgcgctgcttcctcatccaaggatgttgatgactcctggagttgaaaggcataactgggctgaagaaatcaagtctctggcttcttcgccagctgaagctagtacaatagctccagcaaccagtaccaaaagcatctctgatgcccctcagaagccttcctacaggtttttaatctatggtaggactggatggattggtggcctccttggaaagatttgtgaaaagcaagggataccatatgagtatgggaaaggacgcttggaggagcgctctcagctgttggaggacattagaaatgtgaagccaactcatgttttcaatgctgccggagtcactgggagaccaaatgttgactggtgcgagacccataaacaggacactatccgcaccaatgttgtaggcactttgaatctagctgatgtctgtcgcaagcagggtctgctcatgattaattatgctacaggctgtatatttgagtatgatgctaagcaccctgaagggtctggtattggctttaaagaggaagacacgcccaactttattggttccttntattccaaaacaaaagcaatggtggaagagctattgaaggagtatgataatgtctgtactcttagggtcaggatgcctatatcatcagatctaagcaacccccgtaatttcatcacaaagatagctcgttacgacaaggtggtgaacattcccaacagcatgacaatcttggatgagcttctgcctatctccattgagatggcgaaacgggactgcaggggcatatggaacttcaccaaccctggcgctgtaagccacaacgagattctagagatgtacaagaaatacatcaatcctgatttcaagtggaccaacttcacactcgaagagcaggccaaggtgatagtcgcgcctagaagcaacaacgagatggacacgtcgaaactgaaggctgagttccctcagcttctgtccatcaaggattctttgatcaagtacgtctttgagcccaacaggaaggttcctgttaat

SEQ ID NO: 1258 - DNA, 546 bp, Zea mays
atgaaacccaagatatcagattttggaatggcaaggatgtttggaggggaccaaaaccaattcaacacgaatcgggtcgtcggtacatttggctacatgtctcctgaatacgcaatggaaggcattttttcagtcaagtctgacgtctatggcttcggagtcctgatcttggagatcatcacaggaaagagggctgtgagcttccactgtcacgaggactccttgaacatcgctggatatgcgtggcggcaatggaacgaagacaatgctgcggagctgatcgatccagtgataagagcatcgtgctcagttcggcaggtgctgagatgcatccatattgcgttgctgtgcgtgcaagatcacgcagatgagcgacctgacatccccactgtcatccttatgctgagcaacgacagctcgagccttcctaatccgaggccgcctacgctgatgcttcgaggccgtgagatcgaatccagcaagtcaagcgagaaggaccggagccactccattggcactgtgacaatgacacagttgcatggaaga

SEQ ID NO: 1259 - DNA, 570 bp, Zea mays
atggtgcagcaagccgcgaaggaggtgatcccgctgctgacgccttacaagatggggcagttcgagctctctcaccgggtggtgctggcgccgctgacgaggtgccgctcctacggcaacgtgccgcagccacacgccgccgtgtactactcccagcgcgccaccaggggtggcctgctcatcgcggaggccacgggggtgtcggccaccgcgcaggggtacccggagactcctggcatctggacgcaggagcaggtcgaggcgtggaagcccatcgtcgacgccgtccgccgcaagggcgccatcttcgtctgccagatctggcatgtgggcagggtctccaccaacgagctccagccgaacggcgatgcgcctatctcgagcacggacaagcagatctccccggacgccgagtccggaacggcgtactcgaagccgcgccggctgcggacccacgaggtctccggggatcgtcgacgacttcaggcgggccgcacggaacgcgatccaggctggcttcgacgcgttcgagatccacggcgcgcacgggtacctcctgggagcagttca

SEQ ID NO: 1260 - DNA, 792 bp, Zea mays
atgaacgagggcgagtcctggttcgccatcgacctccaccacccgtccaccttcaccacgctcgccatggaccgcaagatgaagcgggccgtcatggacgacctcgagaggttcgtcaggaggaaggagtactacaggcggatcggcaaggcctggaaacggggctacctgctctacggcccgcccgggaccggcaagtccagcctcattgccgccatggccaactacctcaagttcgacgtctacgatctcgagctcaccgaggtcaactggaactccacgttccggaggttgctcatcgggatgaccaaccgctccatcctcgtcatcgaggacatcgactgctcgctcgatctgcaacaacgtgcagacgaagctcaggatgctggtaccaaatccaatccttcagaggacaaggtgacactctctgggctgctcaacttcgtggacggcctctggtcaacaagcggagaggagaggatcatcatcttcacgaccaactacaaggagcggctcgacccggcgctgcttcggcccggcaggatggacatgcacatccacatggggtactgctgcccagagtcgttcaggatcctggcctccaactaccactccatcaccgaccacgacacgtaccctgagatagaagccctgatcacggaggtgatggtgaccccagcagaggtcgttgaagtgctcatgaggaatgaagacaccgacgtcgcgcttgagggcctcatccagttcctcaatgggaagaaagaccacgccaaggatgatagtcgtcaaggt

SEQ ID NO: 1261 - DNA, 333 bp, Zea mays
atggcgccgccgcagccaaagtcgggccttttcgttggcatcaacaagggtcatgtcgtcaccaagcgcgagctgcctccccgcccgtgccaccgcaaggggaaatcaacgaagagggtgtctatggtcaggggcctgatcagagaggttgctgggtttgctccttatgagaagcgtatcactgagcttctgaaggttggcaaggacaagcgtgccctgaagcttgctaagagaaagcttggaactcacaagagggcaaagaagaagagagaggagatggcgggcgtcctcaggaagatgaggtcggctggtacgcacactgacaaaaagaaa

SEQ ID NO: 1262 - DNA, 969 bp, Zea mays
atgtcgtcgttcggacgcaattcatggtgtatcctcgtgctggcctccgtgctcctcctgtcctgcctcgccgacacggccgtggccaagcgaacaggcgagctcaccgtcttctggggccggaacaaggaggagggcacactgcgtgaggcctgcgacaccgggctctacaacaccgtcatcatctccttctacagcgtgttcggccacggccgctacgccctcgacctctccggccacccgctggacggcgtcggcgccgacatcaagcactgccagtccctgggcatcccggtcttcctctccatcggcggcgggggaaaccactactccatcccttcctccgcgtccgcggaggccgtcgcggacaacctgtggaacgcgttcctcggcggcggcaacagcgacgtgccccgccccttcggtgacgcggcggtcaacggcatcgacttctacatcgacgaccacagcgcaccgggcgaccactacgacgagctcgcgcgccgtctcgactacttcaacagcatgtactaccacgccacgacgaagtacgtacggctgacggcgacgccgcggtgcgcgttcccgcccgacgaccccatggcgcgggcgctgcggacggggctgttcgagcgcatccacgtccgcttctacggcgacgccgacaagtgctcgtacaagaacggcgacgtgtccggcgtcgtggaccagtggagcaagtggacggcgaggtaccccaagagccagctttacgtggggctcgccgcggccgagagcggcgtgccggaccacgcgccgccccccgttgaggtctacctcaaatacctctactacgatctgctgcccaaggtgcagaaggcgcccaactatggtggcgtcatggtctggaataggttcaccgacaacaggaccggatacagcggcgccgtcaagggctgggcggcttgcagctatgctggctgtgttaac

SEQ ID NO: 1263 - DNA, 294 bp, Zea mays
atggcgaagaggctgctcccgtcgctgaaccgggtgctggtggagaagctggtgcagcccaagaagaccgccggcggcatcctcctcccggaaacatccaagcagctgaatgctgctaaagtggtggctgttggccctggtgagcgcgacaaggcaggcaatctgatcccagttgctctgaaggaaggcgacactgttcttctgcccgagtatggtggatctgaagtcaagcttgcggctgataaagagtacctcctcttcagagaggatgacattttgggcacacttgtggac

SEQ ID NO: 1264 - DNA, 921 bp, Zea mays
atggccgagaacttccaactccagggccggcacggcaagtcccgcgtccgcgtctcccgcgtctggcgccgcccggccgcggcggggggcgacgtcatcgttgagtggaacgtcgccgtcagtatcgtctccgactgcctcccctcctacacctccagcgacaactccgccatcgtcgccacagattccatcaagaacaccgtgtatgtcaaggcgaaagagtgcacggaagtggtgtccatggaggaattcgccgtgattcttggaaggcatttcacctcgctgtaccctcaggtttcagaggccacggtgactatcgtggagcgcccatgggagcgtgtgactgtcgacggaaagcctcattcgcatgggttcaaagttggtgttgagaagcacagcacagaggtcattgtaaaaaaatctggaagcctgcgtataaattctggaattcaaggatactcgctgctaaagacaactcagtctgggtttgaagggtttgtgacggatcgctataggcttcttcctgatacaagggaaaggatagtagcaacagaagttactgcttggtggaggtatccctttgaacatgtttcgcagctcccatcgaagccattctgcttcacgcagagatatcaggatgtaaagaaagtccttgcagagacgttctttggtcctccggatgttggtgtgtatagtccatccgtacaaaatacgctatacctcatggccaaggaagtccttacaaggttcccagatatatcgtcagtccagcttagaatgccgaaccttcactttctgcctgtcaacttggggagcaaagaagctccgctggtgaagtttgctgatgatgtgtacctgccgacggatgaaccacacgggacgattgaagcaaccttaataagccgtcccatgtcaaagctg

SEQ ID NO: 1265 - DNA, 414 bp, Zea mays
atgttcttgggaccagtaaatttgcgggcaacaaggaaggaggtgcagctcaaggtgaaggaggagtacaatagctacagggacagaactgccttgctgtttctttgttttccggtgattttgttgtttcttcgacaatggttatggaatggatgttttccagtattgccagttcagctataccaggcttggttattattcctgtataccagtttagctttgcgtgagaacatactgcgagttaatggaaatgatatccgcccttggtggatacgtcatcactactgtgccatgctggtgccccctgtaagccgcacaggggaggaaatggggcatcctagttgtacacacaagcaccgaagctgtggaaatttttcctttggcgggccaataagtgacagggtttgttcaaga

SEQ ID NO: 1266 - DNA, 312 bp, Zea mays
atggcccgccacgccgcagatgaagtagtgcttgccggccgtcttgagggtcacggtcgtggcgccggcgctgtcggtgctgagcgcgttgctggaggagcaggcggcgtagtccgccgcgctcacctcgtccaccgtgtgcgccccgccggcgtatttgaactcgagactgtcgccgactttgaacttcttgccgctggcccaggtggcgtagtcgccggtggtcgtccagccggacgcgtccccgacggtgtacttggtcgccaccgccgccgaggcgcagctcacgaggagcagcgcggccaaggccag

SEQ ID NO: 1267 - DNA, 555 bp, Zea mays
atgtctagtcttcaagcggacgggatctcgacctcgccgtcatcaatctcctgctgcaggtccttggggtccttgccgtcgacggtgcacccgacgctgacgcaggtgccgaggatctccttgacggtgccggccaactccttggccatggacctgttcctcatggtcctggcgatctcgacgacgtcgtcgaggccgatgttgccgctgtgcttgatgttcttgaccttcttcctgtccctctcgggctccttgagcgccttgatgacgagcgcggcggcggaggggacgacggagaccttggcctggcggttctggacagtgagcttgacggtgacgcgcaggcccttccagtccttggccgtctccttggcaatgtcctcgccgatcttcttcggggagagaccgagcgggccgatcttgggcgccagggacgacgccgcgccgacctcgccgcccgtcacccggacgaagacctccaccacctgcgacgggtcgagcttgggcggcatggcggcggcggcggcgggggtatgggtagggtttgggaaatgg

SEQ ID NO: 1268 - DNA, 876 bp, Zea mays
atggaaacgacgtcatgcttcctggcctccaaagcatcgtccgccagcaggagcaccgcggtgctgccgcccaccgcccccggcttcgcaaagcctaagccttatctgcagctccttggtagcagccgccgccgtgcctgctgcggcagcatcagcgcgcggggggcgccggaggacggcgccgcgccaccacccatctgtcccgactggcgctcgttccgtgcgcagctctacttcaaagagcagctgccagcggtacagaccggcggcgacaggtgggcgcaccctctagcggagcccgagaaggggtgtctcttgatcgccacggagaagctggacggctcgcacatcttcgagcgcacggtgatcctgctgctgtcgtcgccgtcgtcgctgggccccgtcggcgtgatcctgaaccgcccctcgctcatgtcgatcaaagaggcgtcagggtccatcttcgcggacgacgccgacatcgcgcgcgccttcgcgggccggccactcttcttcggcgggccgctggaggagtgcttcttcgtcatagggccccgagcggcggccggaggcggaggcgacgacgcggtggcgcggacggggctgttcgaggaggtgatgcccggcctccactacggcacgcgggagacggtcgggtgcgcggcggagctggccaagcgcggcgtggtgggcgtccgggacttccgcttcttcgacggcttctgcgggtgggagcgcgagcagctgcgcgacgaggtgcgcgcggggctctggcatgtcgcggcctgcagcgccgccgtgctggagctcgccaccgtcgtcaagggcgggctctgggaggaggtgcaggggctcgtcggggagaggaggctctgg

SEQ ID NO: 1269 - DNA, 558 bp, Zea mays
atgaatgaccttagcaaggggagcaaggcagtttgtggtgcagctagcattggaaacaatgttaacatcggaggtgtacttgtcctcattgacaccaacaacaaacatgggcgcatctttgcttggggcagagataacaaccttcttggcaccacccttcagatgtgcagcagccttgtccttgtcagtgaagacaccggtggactccacgacatactcagcaccagcctcaccccacgggatctcctcggggttcctgatgccaaagacggtgaccggcttctcgccgaagagaagcgtcttggagtccttgagggcgatgtcgctgtgcttccattggccgtgcacggtgtcgtacttgaacatgtacgtcatgtaatccgtggtgatgaaggggtcgttgacggcgacgagctcgacatcctcgctctgcagggcgaccctggccacgagcctgccgatccttccgaaaccgttgattccgatcttgatcttgcccatggctggcgaggtgaggagcggagacgagacgacggagacgggaggatgctggagagg

SEQ ID NO: 1270 - DNA, 462 bp, Zea mays
atggaggcgaggaggagcagcgcggcgctcgtatccgtggccgccgccgccgccgccgtcgcgctgctgctggtgctcgccgccgagccgtcccgagcggagcggttcgtcgtcggcgacgcggcgcggtggacgtgggggtacaactacacggactgggtcatcaggaaggggcccttcttccagaacgacacccttgtgttcatgtacgacccgccgaacgcgacggtgcacgcgcacagcgtgtacctgatgcgcaccgccgcggactaccagtcgtgcaacctcaaggcggccaagctggtggccagcgtcacgcagggcgccggctccggcttcgagttcgtgctccggaagcgcaagcagcactacttcgtgtgcggcgagcgcggcggcatccactgcaccatgggccagatgaagttcgtcgtcaagcccaagagctctgcctgccgcgacgac

SEQ ID NO: 1271 - DNA, 156 bp, Zea mays
atgtcgcgcacccgggcgcccgccgtggccgcgaacaccagcacgcgcgcgcacgccgactccgaggccagcgcccgcagcgccgcggccagcggggccagcagcagcagcagcagcaggcgcggcacgccgccggcctcgaaggccaccagcgcg

SEQ ID NO: 1272 - DNA, 132 bp, Zea mays
atgtcatggctgccgagctcgttcagcctcttgcacgtgaggtggaccgagagcaggtcggacggcgccgaggaggcggcggcgagcttggacaggatggagaggacaaggtcatcgggaagcgcgtccagg

SEQ ID NO: 1273 - DNA, 438 bp, Zea mays
atgttaccgacaaagaagtttgacaacaaagttgaatggggaattgatttagcctctgagcatgaaaggtttttaacagaggatatatttaagaagccagttattgtctataactatccgaaaggaataaaggcattttatatgagactcaatgatgatgacaagacggtggctgcaatggatgttcttgtgcctaaggttggtgaattgattggtggaagccaaagggaggaacggttagatgttctgaaacagaggatacttgatgctggcctgcctttggaaccctatgaatggtacttggacctccgtcgctttggatctgtaaagcacagtggttttgggttgggttttgaaaggatgattctatttgcaaccggaatggagaacatcagagatgttatacccttcccaaggtacccaggaagggctgatctg

SEQ ID NO: 1274 - DNA, 447 bp, Zea mays
atggcggggatgagagtcggcaagctggcgctggctgcggtgctgctgtgcgcggcggcggccatggccacggcgcagcaggcctccggcgtgcgcgccacctacaacttctacaacccgcagcagaacaactgggacctcaacgccgtgagcgcgtactgcgcgacgtgggacgccagcaagccgctgtcgtggcgcatgaagtacggctggacggccttctgcgggcccaccggccccaccggccaggccgcgtgcgggcagtgtctcctggtgaccaacacggcgacgggggcgtccatcacggtgaggatcgtggaccagtgcagcaacggcggcctggacctggactacgacacggcgttcaagcccatcgacaccaacggacagggcttccaggccggccacctcaccgtcaactaccagttcgtcaactgcggcgacaac

SEQ ID NO: 1275 - DNA, 780 bp, Zea mays
atggctgtcggaaagaacaagaggatctccaagggaaagaagggtggcaagaaaaagaccgtcgaccctttctctaagaaggattggtatgacatcaaggcaccgtcggtgttcagtgtgcgcaacatcgggaagactctcgtatccaggacacagggtaccaggattgcttctgagggtctgaagcacagagtctttgaggtttgcctagctgatcttcagggcgacgaggatcaagcttacaggaaaatcaggctccgtgctgaagatgtgcagggcaggaatgtgctcacaaacttttggggcatgaattttaccactgataaactcagatccctagtgaagaagtggcagacattaatcgaagcccatgttgatgtcaagacaaccgacaactacatgttgcgtttgttctgcatcggcttcaccaagaggcgcccaaaccaagtcaagagaacctgctatgctcaggcatcccagatccgtcagatccgccgtaagatggttgagattatgatcaaccaggcttctacatgtgacctgaaagaacttgtttcgaagttcattccagaagttattggtaaggagattgagaagtctacctccagcatcttcccacttcaaaacgtcttcatccgcaaggtgaagatactcaaggcccccaagttcgatcttgggaaactcatggaggttcatggcgactacaaaaaggatgttggtgtgaagcttgaaaggcctgtcgagggaaatgaggctgggcaggaggttgctgctgccgag

SEQ ID NO: 1276 - DNA, 564 bp, Zea mays
atggaaaacgccgcccccgccattgctaagccgtcgctgtccaagaagccctcgccgtcgttccgcctccggaacggcagcctcaacgcactgcgcctgcgccgcgtgttcgacctcttcgaccgcaacggcgacggcgagatcaccctcgacgagatggcctcggcgctcgacgcgctcggcctcggcgccgaccgctccggcctggaggccgcggttggcgggtacatcccggccggcgccgcggggctccgcttcgacgacttcgagtccctccaccgcgcgctcggggacgcgctgttcggccccatgccggtggctgtgaccgaggatgacgacgacgagggggacatgaaggaggcgttccgggtgttcgatgaggacggcgacggcttcatctcggccgccgagctgcaggccgtgctcaagaagctcggcctgcccgaggctcggaacctggccactgtgcaggagatgatctgcaacgtcgaccgcaactgcgacggccgcgtcgacttcggcgagttcaagaacatgatgcaggggatcaccgtgtggggcgct

SEQ ID NO: 1277 - DNA, 357 bp, Zea mays
atggaggagaacaggaacctgccgcaggaggcgttcgacacggtggagctcgccaaggctgccgtggagagcaagtgccccgggatcgtctcctgcgccgacgtcctcgccctcgccgcccgagactacgtccagctggtgggtgggccgtactacgcggtgaagaagggccggaaggacagcaaggtgtccctggcggggaaggtccgcggcagcctgccgcgggccaactcgacggtggacgagctcctgcgcgtgttcgcgggcaagggcctgggcgcggcggacctggtggcgctctccggcgcgcacaccgtcggtttcgcgcactgcgtacacctgctgtgccttctctac

SEQ ID NO: 1278 - DNA, 540 bp, Zea mays
atggcgcggcgatccgcccctctcctgcgccgcctcgtctccgcctcctcaccgcccgcgctgcagtccctcacggaccacgtcggcgtcctcgcgcggcgcacggtgacctacatgccccggcccggggacggcgcaccgcgcgccgtcacgctcatcccaggcgacggcatcggccccctagtcacgggcgccgtgcggcaggtcatggaggcgatgcacgcgcccgtctacttcgagacctacgacgtccacggagacatgcccacggtcccgccagccatcatcgaatccatccgccgcaacaaggtctgcatcaagggcgggctcgccacgcccgtcggcggcggggtctcctccctcaacatgcagctgcgcaaggagctcgatctctacgcctcactcgtccactgctccaacctccccggcctgcccaccaggcacgagggtgtcgacatcgtcgtaatcagggagaacacgagggcgagtactcggggctcgagcacgaggtcgtacccggggtcgttgagagcctcaagg

SEQ ID NO: 1279 - DNA, 756 bp, Zea mays
atggcggcgcaccggccgaacgccgcggcgccgctgctcgccaagctcgacgccaccgccacgccgccggcgaagcgcaacaagtaccccttcttctgcgccgtgctcgcatccatgacctccgtgctcatgggctacaacgtcgcggtgacgagcggcgcgcagatcttcatggcggaggacctcgggatgagcgacgcgcagatcgaggtgctctcgggggtcatcaacatatactcgctcgtcggcgcgctgctggcaggctggacctccgaccgtctcggccggcgcctcaccatcgtcctcgccaacgccttcttcctcgtcggcccgctcgccatggcgcttgccggcgggtacaccttgctcatggtgggccgcttcatcgccggcgtcggcgtcgggtacgcgctcgtcatcgcgccagtctacgctgccgagatcgcgccggcgtcatcccgcgggctcctcagctcacttcctgagatttttatcaacactggggtgatgctgagttacgtgtcgaatctcgccttctcggggctgcccgtgcacctgtcgtggcgggtgatgttcgcggcgggcgtggtgcccaccgtgttcatggcgggcggggtgttcaccatgccggagtcgccgcggtggcttggtatgaagggccgggtcgccgaggccaggtccggcttcaaagacgtcggaccgcccgctgagggcgaacatcggtgctcgagacgaggactcgcgatgaaagaacgg

SEQ ID NO: 1280 - DNA, 711 bp, Zea mays
atgagcttagcggcggagaccatgttggtcagggcgggcttgacctccgtgtacttgcgggtcttgaggccgcagtcggggttcacccagaggatgttggtgtccagcaccgccagcatcttgtcgatgcggtcggcgatctcctcagcccgacgggatcctgggggagtggatgtcgtagacaccggggccgatgcccgcgccgtacttgacgccctcgcggaacacggagagcagcttctcgtcggaccgcgagttctcaatggtgatcacgtccgcgtccatgtcgatgatcgagtggatgatgtcgttgaagttggagtagcacatgtgggtgtggatctgggtggtgtcctggatctcgcagttggtaattctgaaggagtggacagcccagtccaagtagaatgcatgctcagccttgcggagcggcagcccttctctcagtgcagcctcgtcgatttggataacctgaataccaccagcctcaagatcctcgacttccttcttgatcgcaagagcgatctggtagcaagtctcaaacctcggctggtcattccggacgaaggaccagttgaggattgtgactgggccagtcagcatccccttcattgggcgagacgtcatgctctgtgccgtcttcgaccagaaaacggtcatggggttggggcggctcacgtcaccgtagatgatcggaggcttgacgcacct

SEQ ID NO: 1281 - DNA, 237 bp, Zea mays
atggcgtcgcgtccgtcgctgaagtcgaagcccaagggcaagggcgggaagaaggccaccgccgacgacgaggacgccaccgcggcggcgaccacggtgcggctcatgaaggagtggaccacgtggacgatgaagaaggcgaaggtggtggcgcactacggcttcatccccctcgtcatcgtcatcggcatgaactccgagcccaagccctccgtgttccagctcctctcccccgtc

SEQ ID NO: 1282 - DNA, 798 bp, Zea mays
atgttttcacttgacgcggcggcagagggtgacgccgtcgccgacggggagctggcagatctcgacgcggtcgtcggcggcgagcgccttgttgaggacgagcacgaagtcgcggtaaaagcggatgtacttgcgcatgggcgcgtcgtcggggagcacgacggagccgttccacagcgtgttgtcgtagccgatgaggccgcccagcttcaccagcttcagcagccgctcgtggtagttgaggtagttgtccttgtcggcgtccacgaagacgaagtcgaacgacccgtggttcttctcctccgcgatgaggtcgtcgaggacggggagcgcgggaccctcgcggaagtcgatcttgtgggcgacgccggccttctcgatgcagggcaggcccagctcgtagttctcgcggttgatgtccatggccaagatcgtgccgtcctccgggagggcgagcgccgtggcgaggagggagtagccggtgtagacgccgatctccatggtcttcttggcgccgatgagcttgatgagcatgttcaggaactgcccctcgtcggcggaggtcgtcatcaggttccatgggtgcttggcggtgatctcgcggagctccttcatgctctccggctcccgcgggtacacgctcgtgtccaggatgtactggtagaggtcgtcgctcttgagcaggctcttgtggccgacctcggagtgccgcgtcttctgctcgccgttgccgttggcctgctgctcctgcgccggcgccgcctcggtcgccgtggtggccattgcgtgcagtgtagt

SEQ ID NO: 1283 - DNA, 456 bp, Zea mays
atgaacattgagagatactcccatgttatgcacatcagctcaacggttagtggacagttggatgatcatctccagagttgggatgccttgagagctgccttgcccgttggaacagtcagtggtgcaccaaaggtgaaggccatggagttgattgataagttggaagttacgaggcgaggaccatatagtggtggtctaggaggaatatcgtttgatggtgacatgcaaattgcactttctctccgcaccatcgtattctcaacagcgccgagccacaacacgatgtactcatacaaagacgcagataggcgtcgggagtgggtcgctcatcttcaggctggtgcaggcattgttgccgacagtagcccagatgacgaacaacgtgaatgcgagaataaggctgctgcactagctcgggccatcgatcttgcagagtcagcttttgtagacaaagaa

SEQ ID NO: 1284 - DNA, 231 bp, Zea mays
atgctgagttggcgagtgagctttgacaagagggataattgtttttggtatttttcccgcctacgtttagcattgtggtcctcttggagtagctcttcgatctttgcattgctttgtgcacttattgagttgtacagtttgtttagcatatcttcttttgatttctccacttggcaaagtacaatagcctttggaacatttgcagccaaactgttcaaaacagcttcaaca

SEQ ID NO: 1285 - DNA, 738 bp, Zea mays
atggggaaaattcttcctgaagggatcggtgaggttcaggaaatcatcgacatgtgtgattatgctgtggggctaagtcgccaactaaatggatccattataccatctgaacgaccaaaccatatgatgatggaggtgtggaatccccttggagttgtgggtgttataacggcatttaatttcccttgtgctgtgcttggttggaatgcttgcattgctttggtctgtggaaattgtgtcgtctggaaaggtgctccaacaactccactgatcactattgcaatgacaaaaatagtggctagtgtattggagaagaacaacttgccaggcgcaatttttacatctttttgtgggggcactgaaattggtcaagcaattgcccttgacattaggatacctttggtttcattcactggaagtacaagggctggtctaatggttcagcaacaagttagtgcaagatttggtaaatgccttcttgaacttagcggaaacaatgccatcattgttatggatgatgcagatatccagctagatgtgcgatctgtcttgttcgctgctgttggtacagcaggacaacgctgcactacatgtcataggctgattcttcatgagaatatatatcaaaccttccttgatcagcttgttgaggtatacaaacaagtccgaattggggatccgttggagaaaggcaccttactgggaccactgcacactcctgcttcaaaagagaacttt

SEQ ID NO: 1286 - DNA, 1074 bp, Zea mays
atggacgtacgttgttcgttcaagcctcaaggcttgacgccacgaaggaagcctgcagcggaaggcagtcttctctcacgcggtggcgatggccgacttcatggcctcgaacctgggctccttggcctcgaacttgtggcgcacgtacaggttcatgtagtcctcgaacacgaagctcgggtacgcggcctcggcgcggtcctcctcggcggcgccgacgagcgcgggggccgggaagatgacggcgtcggcgcccgggttgtagaaggacgcgacggacatgcggttgccgtcggggcgcgtgagcacgcggtgcatgacgctcttgtaccgcccgttggtgatcacctccagctggtcgccgacgttggcgacgatggcgtggagcatgggcggcacgtccacccactccccgcccctgagcagctgcaggccgctcacctggtcgtcctggaacagcagcacgatgccgccggcgtcggtgtgcgcgcggaggccgtcgacgaggtccgggcgcgggcacggcgggtacgcgctcaccttggtgccgaacgtcgggccgtccgaccccgcgaaggccgccttcaggtacccgggctccaggcccaggttctcgcacagcaggtccagcagcctctccgacagcttgcggatctccgatgcgaactgctccatcacctgcctgtagcggtcgtcgacgtcggggaggtcggcgaggttggaggccgggaggtggcggacgaagaaggtgctctcccagtccacgtccttgacgtcggcgcccttctcgccggcctccagcgtccgggccgcgaactcctggaacttggcctcccggaaggtggcgtagtgcgccttggtcagccgctccacctcgtccatcagctcgtgcgagatgccgtggttcagcagctcgaagaagccccagttctcgcagccgtcgcggatgacctccatggccgtggccctctcctctgtctccagcttctccatgttcaccaccgggaaggaggaaaccgtggccgccatctctctctagctagctctcgtgtctcgcagctgggttgctttgct

SEQ ID NO: 1287 - DNA, 924 bp, Zea mays
atggacaacgcccgcctcgccatcgccaacatcggcaagctcatgttcgcgcagttctccgagctcgtcaacgagttctacaacaacgggctcacctccaacctggccggcagccgcaaccccagcctggactacggcttcaagggcaccgagatcgccatggcctcctactgctccgagctccagtacctgggcaaccccatcaccaaccacgtgcagagcgcggagcagcacaaccaggacgtgaactccctgggcctcgtctcggccaggaagaccgccgaggcgatcgacatcctgaagctcatgtcgtccacctacatcgtggcgctgtgccaggccgtggacctgcgccacctcgaggagaacatcaaggcgtcggtgaagaacaccgtgacccaggtggccaagaaggtgctgaccatgaacccctcgggcgagctctccagcgcccgcttcagcgagaaggagctgatcagcgccatcgaccgcgaggccgtgttcacgtacgcggaggacgcggccagcggcagcctgccgctgatgcagaagctgcgcgccgtgctggtggaccacgccctcagcagcggcgacgcggagcgggagccctccgtgttctccaagatcaccaggttcgaggaggagctccgcgcggtgctgccccaggaggtggaggccgcccgcgtggcggtcgccgagggcaccgcccccgtggcgaaccggatcgcggacagccggtcgttcccgctgtaccgcttcgtgcgcgaggagctcggctgcgtgttcctgaccggcgagaggctcaagtcccccggcgaggagtgcaacaaggtgttcgtcggcatcagccagggcaagctcgtggaccccatgctcgagtgcctcaaggagtgggacggcaagccgctgcccatcaacgtcaag

SEQ ID NO: 1288 - DNA, 459 bp, Zea mays
atgtcggcgaggtccacatcccgctgtccgagctcctctccggcgcccccgacggccctgtccccgccaagttcgtcgcctaccaggtgcgcaagatctcctccggcaagccccagggagtcctcaacctctcgtacaagctcggcgaggtcgccaacggctacgcccccgcttccgccgcccagtccgcctacgcccatcctccaccgaccgccgcgtacccgcctccttcaggcaaggctgacgcctacgcgcctcccgccgcgtacccgcctccttcgggcaaggccgacgcgtacgcgccccctgccaccgcatacccgccggcagccaaggccgacgcgtacccacctccatacggcgcctacccgcccgccggcggcaaggccgacgctgcttacccgccctcatccggctacccacccgcggcaggcaagccagccaaggggggcgaaccgg

SEQ ID NO: 1289 - DNA, 753 bp, Zea mays
atgggctccaccgccggcgacgtggccgcggtggtggacgaggaggcgtgcatgtacgcgatgcagctggcgtcgtcgtccatcctgcccatgacgctgaagaacgccatcgagctgggcctgctggaggtgctgcagaaggaggccggcggcggcaaggcggcgctggcgcccgaggaggtggtggcgcggatgcccgcggcgcccggcgaccccgccgccgcggcggccatggtggaccgcatgctccgcctgctcgcctcctacgacgtcgtccggtgccagatggaggaccgggacggccggtacgagcgccgctactccgccgcgcccgtctgcaagtggctcacccccaacgaggacggcgtgtccatggccgccctcgcgctcatgaaccaggacaaggtcctcatggagagctggtactatctcaaggacgcggtgctggacggcggcatcccgttcaacaaggcgtacgggatgacggcgttcgagtaccacggcacggactcgcgcttcaaccgcgtgttcaacgagggcatgaagaaccactcggtgatcatcaccaagaagctgctggacttctacacgggcttcgagggcgtgtcgacgctggtggacctgtttctatataccttaccattcctatttaattcagttaccgctttcgggagacccttaatatgcgtgcgcgacggcacattttttcgttatcctctcaaccccgatctagcaaccgaatccgtttactat

SEQ ID NO: 1290 - DNA, 399 bp, Zea mays
atgcccggcgcggacgtcggcgccgagcaggagcaggccgccgcgagggggcaggagacggccgggtccgcctccacggcggcgccgctcaccatcttctacggcggcagggtggtcgtgttcgacgacttcccggcggagaaggcggccgaggtcatgcgcctcgcagctggcgccgagcgcccggcggccccggccccggcgccggcgccgcgcgacgacctgcccatcgcccggaaggcgtcgctgcagcggttcctggccaagcgcaaggaccgcctcgtggagcgcgccccctacgcccgcccgtccccatccgaggaggcggagaaggcgaagccggcctcctcgtggctcgggctcggcggcacggacgccgagcgcctcaacatcgcgctg

SEQ ID NO: 1291 - DNA, 1854 bp, Zea mays
atgagcagcatgatgaacggcaccgacagctacggcgtcaccaccggcttcggcgccacgtcgcacaggaggaccaaggagggcggcgcgctccagagggagctcatcagattcctcaatgctggcgcgttcggcaccggcgccgacggccacgtgctgccggccgaggccacgcgcgcggcgatgctcgtgcgcatcaacaccctcctccagggctactccggcatccgcttcgagattctggaggccatcgccaagctgctcaacgccaacgtcacgccgtgcctgccgctccggggcaccatcaccgcgtcgggcgacctcgtcccgctctcctacatcgccggcctcatcacgggccgccagaactccgtcgcggtgggccccgacggcaggaaggtgggcgccgccgaggcgttcaggatcgccggcatcgagcacgggttcttcgagctgcagcccaaggagggcctcgccatggtcaacggcaccgccgtgggctccggcctcgcctccaccgtgctcttcgaggccaacgttctcgccgtcatggccgaggtcatctccgcggtgttctgcgaggtcatgaccggcaagcccgagttcaccgaccacctgacgcacaagctgaagcaccaccccggacagatcgaggccgccgctatcatggagcacgtcctggaaggcagctcgtacatgaagctggccaagaagctcggcgagctcgacccgctgatgaagccgaagcaggacagatacgcgctccgcacctccccgcagtggctgggcccgcagatcgaagtgatccgctttgccaccaagtccatcgagcgcgagatcaactccgtcaacgacaacccgctcatcgatgtgtcccgtggcaaggcgctccacggcggcaacttccagggaactcccatcggcgtgtccatggacaacacccgtctcgcgctcgccgccatcggcaagctcatgttcgcgcagttctcggagctggtgaacgactactacaacaacggcctcccgtccaacctgtccggcgggcgcaaccccagcttggactacggcttcaagggcgccgagatcgccatggcctcctactgctcggagctccagttcctgggcaacccggtgaccaaccacgtccagagcgcggagcagcacaaccaggacgtgaactccctgggcctcatctcgtccaggaagaccgccgaggcagtggacatcctgaagctgatgacgtccacgttcctgatcgcgctgtgccaggccatcgacctgcggcacctcgaggagaacgtgaaggccgcggtgaagaactgcgtgacgcaggtggccaagaagtcgctgagcctgaacgcccggggcgggctccacaacgcgcgcttctgcgagaaggacctgcagacggcgatcgaccgcgaggcggtgttcgcgtacgcggacgacccgtgcagccccaactacccgctgatgcagaagctccgcgcggtgctggtcgagcacgcgctggccaacggcgacgccgagcgcgccgcggagacgtccatcttcgccaaggtggccgagttcgagcagcaggtccgcgcggcgctgcccaaggaggtggaggccgcgcgcgcggccgtggagagcggcagccccctggtccccaacaggatcagggagtgccggtcctacccgctgtaccggttcgtgcgcgaggacgtcggcaccgagtacctgaccggcgagaggaccaggtcccccggcgaggagctcaacaaggtgctcgtggccatcaaccagcgcaagcacatcgacccgctgctcgagtgcctcaaggagtggaacggcgcgcccctgccgctctgc

SEQ ID NO: 1292 - DNA, 795 bp, Zea mays
atggctaggggattgaagaagcacttgaagaggctcaatgcgcccaagcattggatgctcgacaagcttggcggagcttttgctcccaagccatcttctggacctcacaagtccagggagtgccttcctctgatcctcatcatcaggaacaggctcaagtatgctctgaactaccgtgaggtcatttctatcctgatgcaacgccatgtacttgttgatggcaaggtcaggactgacaagacctaccctgctgggttcatggatgtcatttccatccccaagacaatggagaactacaggctgctttatgacaccaagggccgcttccgtcttcacccaatcagggatgaggatgccaagttcaagctctgcaaggtgaggtctgttcagtttggccagaagggcatcccctacctgaacacctacgacggccgcaccatccgctaccccgacccgctcatcaaggccaacgacaccatcaagatcgatctggagaccaacaagatcatggacttcatcaagtttgacgtcggcaacgtggtcatggtgaccggcgggaggaacaccgggcgtgtaggtgtgatcaagaacagggagaagcacaagggcggcttcgataccatccacgtcgaggactccatgggccaccagttcgccacccgcatgggcaacgtgttcaccatcggcaagggcaacaagccgtgggtgagcctgcccaagggcaagggtatcaagctcagcatcatcgaggagcagaggaggcgcgactttgctgcccaggctgctgccaaggca

SEQ ID NO: 1293 - DNA, 1407 bp, Zea mays
atgggcgcctccaccacgccgctcgcgtcggcggcggcgctgcttctgctgctgctcgcgccgctcgccgcggcggcggacagcatgtcgatcgtctcctacggcgagcggagcgaggaggaggcgcggcggatgtacgccgagtggatggcggcgcacggccggacctacaacgccgtcggcgaggaggagcgcaggttcgaggtgttcagggacaacctccgctacgtcgacgcccacaacgccgccgccgacgcgggcgtccactccttccgcctcgggctcaaccgcttcgccgacctcaccaacgacgagtaccgcgccacctacctcggcgtcaggagcaggccgcagagggagaggaggctcggtgacaggtacctggccggcgacaacgaggacctgccggagtccgtcgactggcgggccaagggcgccgtcgcggaggtcaaggaccagggcagctgcgggagttgctgggctttctcaacaatagcggctgtggaaggcatcaaccagattgttactggcgacatgatctccttgtctgagcaggagcttgttgactgtgacacttcatacaaccaggggtgcaatggaggtttgatggactatgcgtttgagttcatcatcaacaacggcggaatcgacaccgaggaggattacccttacaagggcacggacggacggtgtgatgtcaacaggaaaaacgccaaggttgttactatcgacagctatgaagatgtaccagcgaacagtgagaaaagtctgcagaaggcagttgcgaaccagcccatcagtgttgcaattgaggctggtggcagagcatttcagctctacaactcgggtatcttcacaggaacctgtggaacagcgttggaccatggtgtcacggccgtcggctacggcacagagaacggcaaggactactggatcgtgaagaactcttggggcagcagctggggcgagtccggctacgtcaggatggagcgcaacatcaaggcgtccagcggcaagtgtggtatcgccgttgagccgtcgtaccctctgaagaagggcgccaaccccccgaaccctgggccgaccccgccttcccccaccccgccgcccaccgtctgcgacaactactactcgtgccccgacagcaccacctgctgctgcatctatgagtacggcaagtactgcttcgcctggggctgctgcccgctcgagggcgccacctgctgcgacgaccactacagctgctgcccccatgactaccccgtctgcaacgtcaagcagggaacctgcctcatgggcaaggacagcccactgtcactgtcagtgaaggctacgaagcgcaccctggccaagccgcactgggctttccctggcaacacagctgctgacggcatgaagagcagcgca

SEQ ID NO: 1294 - DNA, 663 bp, Zea mays
atggtgaagagcacgacgacgatgggggcggcgagctgcggcggcggcgtgctgccgctggcgtcgctgaaccacatcagcatcgtgtgccggtcggtggaggcgtcgctgcgcttctacacggacgtgctcggcttcgtccctatccgccgccccggctctttcgacttcggcggcgcctggctgttcaactacgggatcggcatccacctgctgcagtcggaggaccccggcagcctcccgccggagaagggagagatcaaccccaaggacaaccatatctccttccagtgcgagagcatggtggcggtggagcggcggctgaaggagatcggcatcccgtacgtgcagcgctgcgtggaggagggcggcatcaacgtggaccagatcttcttccacgaccccgacggcttcatgatcgagatctgcaactgcgacaacctccccgtcgtcccgctcgccggcgaccagcagcgcgcgccggccgcttgcaggcgggctccggcggcggtcaataccgtcaagcagcagcagcagggcagcgtggtgcctgcttcttccgctccggtcacgacggcggcggcgcagtgcatgccgtcggcggccacggcggcgcaagccatccgcgtcgccgaggagtcgtcgtcgcacatttcgtgcgcg

SEQ ID NO: 1295 - DNA, 276 bp, Zea mays
atggtggaaggccacgccagcctcaaggtgctggcgcgccgccggcccaagcagctcctgaagctcgtcgccgggctgcaccagctgcgcgtcccgccgctccacctcaacgtcaccgccgccgtcgacgccatggtcctctacaccttcagcctcaaggtggaggatgactccaagatgggctctgtcgaggacattgccaccgccgtgcacgagattctcggcagcatacagcggcagcagcaggaggaggaggaggaggagaccgccgccatg

SEQ ID NO: 1296 - DNA, 1419 bp, Zea mays
atggcccagactctgtccgccgcctccgagctggccaccctgaagcgcccgttcggcaacgacgggttcggcgatggcagcaacaacggcagcgccaccggcgagaagcccaaggcgcggcggcgggaggcggacccggcggcggcgctggccgcggcgcggcacgagttcggcgagcacggcggcgtgaacatgtccatcgaggcgtcggcgacgttcacggtgatggagccggacacgatgcggcggctgttcgcgggcgagctgggccccgaccgcggcgacatgtacatctacagccggcacttcaacccgacggtgctggcgctggggcggcagatggcggcgctggagggcacggaggcgggctactgcacggcgtccgggatgtccgccatctcgtccgtgctgatgcagctggtgggcgccggcgggcacgtggtggcgtcgcggtgcctgtacggcgggacacacgcgctgctggcccggttcctgccgcgcgcctccggggtgcgcgccaccttcgtggacgccgacgacgaggccgccgtgcgcgccgcggtggtccccggcgagacgcgggtggtgtacgtggagaccatgtccaacccgacgctcgccgtcgccgacatccccatgctggcgcgggtggcgcacgaggccggcgccaagctcgtggtggacaacaccttcacccccgtggtggtgtcgcccgcgcgcctcggcgccgacgtcgtcgtccacagcgtctccaagttcatcagcggcggcgccgacatcatcgccggcgcgatctgcgggccggcgagcctggtgaacgcgatgatggacctgcaggagggggcgctgatgctgctgggccccacgatgaacgccaaggtggcgttcgagctgtcggagcggctgccgcacctgccgctgcggatgcaggagcactcgcgccgcgcgctggcgttcgccgagcggatgcaggggctgggcctgcgcgtgctgtacccgggcctcccgggccacccgcaccacgcgcgcctggccgccatgggcaacccgggctacggctgcggcggcatgctgtgcctcgacatgggcaccgaggagcgcgccaaccgcctcatgcaccacctccagaacaccacccagttcggcctcatggccgtcagcctcggctactacgagacgctcatgtcctgctccggcagcagcaccagcagcgagatgccgcccgaggaccgcgcgcgcgcgggcatctccccgggcctcgtccgcatgtccgtcggctacaacggcacgctggagcagcgctgggcgcagttcgagcgcgcgctcgcgctcatgcagacgccgacgcccacgcaccacctcaagcaggccgccgaccgcgacggccccgaagccgccaacaaccaccaccgcaagcac

SEQ ID NO: 1297 - DNA, 231 bp, Zea mays
atgtcgttgacggccttgaacgcggcggggcggagcgtgaggttgggcggcgactgctgctcgctgggctgggtgggcgtggcgtccagcaggatggaggcgtcgcagccctgcacgaagcagtcgtggaagtggagccggatcagcgccgcggcgagccccacgttctgccggaccgccgacgccaggaactcccgcacgatggactccgccttggggcagctcttcttg

SEQ ID NO: 1298 - DNA, 672 bp, Zea mays
atgtctagcctcggagtcacgtccatggccgtcgccgccgtgtactatcgcttcagctggcaaatggagggcggcgaggtgccggtgatcgagacgctgggcacgttcgcgctctccgtcggggcggcggtcgggatggagttctgggcgcggtgggcgcaccgggcgctgtggcacgcctccctgtggcacatgcacgagtcgcaccaccggccgcgcgagggccccttcgagctcaacgacgtgttcgccatcgtcaacgccgcgccggccatctccctcctcgcctacggcttcttccaccgcggcatcgtgcccggcctctgcttcggcgcgggcctggggattacgctgttcggcatggcctacatgttcgtccacgacggcctggtccaccgccgctttccggtcggccccatcgccgacgtgccctacttccgccgagtggctgcctcgcacaagatacaccacatggacaagttcggcggcgtcccgtatgggctcttcctgggaccaaaggagctggaggaggttggtggcctggacgagcttgttagcagtccggtgagtgaagctactgatactgaagacgcaggagaagaaaagacgcgtccagttgtatgcgttgtccgaacaagcgtgttcatgggccagagtgtgccaaatgagttc

SEQ ID NO: 1299 - DNA, 762 bp, Zea mays
atgatgcttagggtttccccgtccccggccgccgcggtgccaacccagctctccggtgcgcccgcgacccctgctcccgtcgtcagggtggcggcgccgcgcggcgtcgcctcgccggccgctggcgccgcgtgcagggccgcgggcaaggggaaggaggtgctcagcggggtcgtgttccagcccttcgaggagatcaagggggagctcgccctcgtgccccagtccccagacaagtcgctcgcgcgccacaagttcgtcgatgactgcgaggccgccctcaacgagcagatcaacgtggagtacaacgcctcgtatgcataccactccctcttcgcctacttcgaccgcgacaacgtggctctcaaaggatttgccaagttcttcaaggaatccagcgacgaggagagggagcacgctgaaaagctcatggagtaccagaacaaacgtggaggcagggtgaggctccaatcgattgtgacgcctttaaccgagtttgaccaccctgagaaaggagatgctctgtacgctatggagctggctctggccctggaaaagctggtcaatgagaagctgcacaacctgcatggtgtggcaacaaggtgcaatgatcctcagctgacagacttcatcgagagtgagttcctcgaggagcaggtggaagccataaacaagatctccaagtatgtcgcccagctgaggagagtgggcaaggggcacggggtgtggcacttcgatcagatgctgcttgaggaagaggcc

SEQ ID NO: 1300 - DNA, 1338 bp, Zea mays
atggcggtcacgatcacgtgggtgaaggcgaggcagatcttcgacagccgcggcaaccccaccgtcgaggtggacgtgggccttagcgacggcagctacgcgaggggggccgtacccagcggcgcatccactgggatatatgaggccttggagttgagggatggaggatctgattatcttggcaagggtgttcttaaggctgtcagcaatgtaaataacattattggaccagcaattgttggaaaggaccccactgagcaggttgagattgacaacttcatggtccaacagcttgatgggacctccaatgagtggggctggtgcaaacagaagcttggagcaaatgccatccttgcggtttcacttgcggtgtgcaaagctggagctatggtgaagaagattcctctttaccagcacatcgcaaatcttgctggaaacaaaactctggtgctccctgtacctgcctttaacgtgattaatggagggtcacatgctggaaacaagcttgccatgcaggagttcatgatcctcccaactggtgcctcctcgttcaaggaggccatgaagatgggagttgaggtgtaccacaacctgaagagcatcatcaagaagaagtacggtcaggatgcgacaaatgttggggatgaaggtggttttgcacctaacattcaggaaaacaaagaaggccttgaactattgaaggcagccatagaaaaggctggctacactggaaaggtggtcattggaatggatgttgctgcttctgagttcttcggtgagaaagacaagacttatgatcttaatttcaaggaggagaacaacgatggctcaaagaaaatttcaggcgacagcctgaaagacctgtacaagtcctttgtttctgagtaccctatcgagtcgatcgaagacccatttgatcaggacgactggagcacttatgccaaactcactgatgagattggacagaaagtgcagattgtaggagatgatcttctcgttaccaaccccaccagggtcgccaaggccatcaatgagaagacctgcaatgctctcctcttgaaggtgaaccaaatcgggtctgtgaccgagagtatcgaagctgtcaggatgtccaagcgcgccggatggggagtgatggcaagccacaggagtggcgagacagaggacaccttcattgctgacctctcagttggcctgtctacgggccaaatcaagacgggagctccttgccggtctgagcgcctggccaaatacaaccagctgctcaggatcgaggaagagctcggtgatgccgcggtctacgccggagcaaagttcagggcaccagtggagccctac

SEQ ID NO: 1301 - DNA, 381 bp, Zea mays
atgcgaagctggcgtgcccgctctgccgcaccccggcgcccgacatcaagtccatgcagatccaccacgaggcgcgccaccccaagctccccttcgagccggagaagctcctcaacctgcactcctccgcccccgctgctgccgccgccgccgccgctgccgccgccgctgccgaggccaccacctccaagcccaagcccggcgtccgcggcagcctcaagaagtaagcttgctgggcttggttggctcgcccgcctgcatggggcgcaattcccttcggtttcaatcccatccgccgacccgatctataatcaatcaaaccgccgccctccggcctggcggctgccgcagtcggcctgcggtgtactgttagtctgctgc

SEQ ID NO: 1302 - DNA, 411 bp, Zea mays
atggcgcccaaggccgagaagaagcccgcggagaagaagccggcggaggagaaggccgagaagaagccaagggcggagaagcgcgtgccgagcaaggagggcggcgagaagaagggaaagaagaaggcgaagaagagcgtcgagacgtacaagatctacatcttcaaggtgctcaagcaggtgcacccggacattggcatctcgtccaaggccatgtccatcatgaactccttcatcaacgacatcttcgagaagctcgccgccgaggcagccaagctcgcccgctacaacaagaagcccaccatcacctcccgggagatccagacctcggtgcgcctcgtcctccccggcgagctcgccaagcacgccgtctccgaagggaccaaggcggttaccaagtttacatcctct

SEQ ID NO: 1303 - DNA, 549 bp, Zea mays
atggagggtcttcaggtccttcccttggaggacgttgtctctgaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtac

SEQ ID NO: 1304 - DNA, 1599 bp, Zea mays
atggaccaggtggggcggaagaagtacgtcaagcaggtgacgggccgccacaacgatacggagctccacctcgccgcgcagcgcggggacctcgaggccgtgcgccagatcatcgccgagattgacgcccaaatgaccggcaccggcgaggagtttgacaacgaggtcgccgagatccgcgccgctatagtgaacgaggccaacgagatggaggcgaccgcgctgctcatcgccgccgagaaggggtttcttgacatcgtcgtcgagctgctcaagcactccgacaaggacagcctcaccaggaagaacaagtccggattcgatgctctgcacgtcgctgcaaaagagggccacagagatattgtcaaggtacttctggaccatgatccatcccttgggaaaacgtttggccaatcgaatgtgactcctctcataactgcggcgattagaggccacactgaggtggtgaacctactgctggagcgagtttctgggttggttgagttatcaaaagcgaatggaaagaatgccttgcactttgctgcccggcaggggcatgtggaaatcgtgaaggctttgctagatgctgatacccagcttgctcggaggactgataagaaaggccagattgctctacacatggcagtaaaaggtactaacccggaagttgttcaagcgcttgtgaatgccgatccggcaatagtcatgctacctgacagaaatggcaacttagctctgcatgttgcaaccagaaagaaaagatcagagattgtaaacgtgcttctgcttctcccggatatgaacgtgaatgcgttgactagggaccggaagaccgcattcgacatcgccgagggcctcccactatcagaggagtcccaagaaataaaggagtgcttgtcccgcgctggcgcggtcagagcaaatgagctgaatcagcctcgggatgagctcagaaaaacagttacagagatcaagaaggacgtgcatactcagcttgagcaggcgagaaaaaccaacaagaatgtctacggcatcgcgaaggagctaaggaaactccacagggagggcatcaacaacgcgacgaattcagtcacggtcgtggcggtgctcttcgccacagtggcgttcgccgcaatcttcacggtgcccggcggcaacaccgacgacggcgtagcggtggccgtgcacgcgacatccttcaaggtgttcttcatcttcaacgccgtcgccctcttcacgtcgctagcggtggtggtggtccagataacggtggtcaggggcgagaccaaggcggagaggcgggtggtgggggtcatcaacaagctgatgtggctggcctcggtgtgcacgacggtcgcgttcatatcctcctcgtacatcgtggtggggcggcacttcaagtgggcggcgctcctggtgaccctgatcggcggggtgatcatggccggcgtgctcggcacgatgacgtactacgtggtgaagtccaagcgcgtgcgcaagatcaggaagaaggtgaagtcgacgaggaggagcggctcgaactcgtggcaccacaactcggagctctcggattcggaggtcgaccgcatctacgccata

SEQ ID NO: 1305 - DNA, 1011 bp, Zea mays
atggagccgttcgtgatcgccaccaaccggcagctcagcgtgacgcaccccgtgcacaggctgctgctgccgcactaccgcgacaccatgaacatcaacgccctcgcgcgccagaagctcatcaacgccggcggcatcttcgagatgaccgtcttcccgcgcaagtacgccatcgagatctcctccaaagtctacggcagctggaacttcaccgagcaggccctccccgacgacctcatcaagcgaggcatggccgttccagatccgtcgagcccctacaaggtgcggctgctgatcgaggactacccgtacgcctcggacgggctggccgtgtggcacgccatcgagcagtgggtgacggagtacctggccatctactaccccaacgacggcgtgctgcaggccgacgtggagctgcaggcgtggtggaaggaggcgcgcgaggtcgggcacgccgacctcaaggacgagcactggtggcccaagatgcagacggtgccggagctcgtgaaggcctgcaccaccatcatctggatcgcgtcggcgctacacgctgccgtcaacttcgggcagtacccgtactgcgggtaccacccgaaccggccgtccgtgagccggcggcccatgccggtgccgggctccgacgcgtacaaggagctggagaagaacccggagaagttcttcgtgcgctccatcaccgcccaattccaggccgtcgtcggcatctcgctgctggagatcctgtccagccactcctccgacgaggtgtacctcggccagcgcgacaccaaggagtggacgtcggacgccaaggcgcaggaggcgttcaagcggttcggcgcgcggctgaccgagatcgagaaacgcgtggaggccatgaacaaggacccgcgcttcaagaaccgctacagcgcggcccagttcccctacaccctgctcttccccaacacctccgacaagggcgataacaccggcgtcaccgccaagggcatccccaacagcatttccatc

SEQ ID NO: 1306 - DNA, 954 bp, Zea mays
atgctccgcgtgcacggcacgttcccgtccttctcgcccgacggggcgcacatcgccgtcaacggcgacttcttctcgacgccgggcgtcagcgtgctccgctccgacggttccaggcggtggacggtgagcaaggagcccgacctgttctacaccacctggagccccacggagcggggggtggtgttcacgtccaagggccccatcttcgagaccccgaaggcgacggtccggatcgcgcgcgtggagttcgacccggccgacctcacggacgacggccgcggggagggtgaggtgcgcgccacggtgaggccgctgacccggccggaggccggcaacgacgcgttcccggcggtgtcgccgtgcgggcggtggctggtgttccggtcgggccggacggggcacaagaacctgtacgtcgtggacacggcgcgcggcgaggaaggcggagtccggcggctgacggagggcgagtggatcgacacgatgccgagctggtccccggacgggagtctgatcgcgttctcgtcgaaccgtcacgacccggcgaacccggccgtgttcagcatctacctggtgcggcccgacggctccgggctgcgccgcgtgtacgtggccggggcggagggcagcgcggaggcggacaaggagcggatcaaccacgtgtgcttcagcccggactcgcagtggctgctgttcacggccaacctgggcagcgtcgtggcggagcccatctcggggcccaaccagttccagccgtacggggacctgtacgtgtgccgcctcgacggatcggacctgcgccgcctcacctgcaacgcctacgagaacggcacgccggtgtgggggccagcaagcgccgggctcgggctggagtcgctgtccatgggcccgccctccggggaggacgccttgggccagttcgacgagccgctgtggcttacctgcgacgtc

SEQ ID NO: 1307 - DNA, 693 bp, Zea mays
atgctccgcaagcacacctacttcgacgagctcgcgcagaacaagcgcgccttcgccgccgcgtccgcgtccgcggccaccgcctcgtcgctggccaacaacccttcttcctacgcgtcgctctcccccgcgaccgcgacggccgccgcgcgggagcacctcttcgacaagacggtcacccccagcgacgtgggcaagctgaaccggctggtgatcccgaagcagcacgccgagaagcacttcccgctgcagctcccatccgccggcggcgagagcaagggcgtgctcctcaacctggaggacgccgcgggcaaggtgtggcggttccgctactcgtactggaacagcagccagagctacgtgctcaccaagggctggagccgcttcgtcaaggagaagggcctccaagccggcgacgtcgtcggcttctaccgctccgctgccggcgccgacaccaagctcttcatcgactgcaagctgcggcccaacagcgtcgtcgtcgcctcgacggcaggcccgtcgcctccggcgccggtggcgaaggccgtgcgtctcttcggcgtcgacctgctgacggcaccggccaccgccgcggcgccggcggaggccgtggccgggtgcaagagagccagggacttgggttcgcccccgcaggcggcgttcaagaagcagctcgtggagctggcactagtg

SEQ ID NO: 1308 - DNA, 357 bp, Zea mays
atggcgatggcaccgtgcgcacccgcctccgtctcctccttccccgcccgcccagtgcgggccccttccgctgtccggccgcgcgccgccgcgatccgcgccactgcggcggcggcggagggtggcaggtggtgggcgccgctgctggggtggtcggggaaggccgactaccttgaggccccggccccggtgccggcggtgctgcaggatgacgacgcggccgcggcgcgcaggcagttcgtgggggggctgacggaggagaaggcccgccagctgcgggcgcggatggcgcagacggagtccttccacgacgccatgtaccactccgccatcgcctcacgcctcgcccgctccgcc

SEQ ID NO: 1309 - DNA, 1350 bp, Zea mays
atgagggagatcatcagcatccacatcggccaggccgggatccaggtcggcaacgcctgctgggagctctactgcctcgagcacggcatcgagcacgatggcaccatgcccagtgattcctcggttggcgtcgcacatgatgccttcaacacgttcttcagcgagactggttccggcaagcatgtgcccagggccatcttcgtcgaccttgagcccactgtcatcgacgaggttcgcactggctcgtaccgccagctcttccacccagagcagctcatctcggggaaggaggacgcagctaacaactttgcccgtggccactacacggttgggaaggagattgtcgatctatgcctggaccgtgtgcgcaagcttgcagacaactgcactgggctgcagggattcttggtgttcaatgctgttggtggtggtactggctctggacttggttcactgctgttggagcgcctttcagttgattatggcaagaagtctaagcttggtttcaccatttatccttccccacaggtgtcaacagctgttgtagagccatacaacagtgtcctctcgacccactccttgctcgagcacactgatgttgcagtcctcctggacaacgaggctatctatgacatatgcaggaggtcccttgacatcgaaaggccaacctataccaacttgaacaggctgatctcacagatcatatcatcacttaccacctccctgaggtttgatggggctatcaatgtggatgttactgagttccagaccaaccttgttccatacccacgtattcatttcatgctttcctcatatgcccctgtaatatctgctgagaaggcctaccatgagcagctctctgtgcctgaaatcaccaatgctgtatttgagccctcaagcatgatggccaagtgtgacccaaggcacggaaagtacatggcttgctgcttgatgtaccgcggtgatgttgttcctaaggatgtcaacgctgcagttgcaaccatcaagaccaagagaactgtccagtttgtggactggtgccccactggattcaagtgtggcatcaactatcagccaccctctgttgtccctggaggtgacctggcaaaggtccagcgtgccgtgtgcatgatcagcaacaacaccgccgttgccgaggtgttctcacgcatcgaccacaagtttgaccttatgtacgccaagcgtgcattcgttcactggtatgtcggtgagggtatggaagagggtgagttctcagaagcccgtgaggacttggctgctcttgagaaggactatgaggaagtcggtgcagagggtgccgatgatgagggtgacgagggagacgactat

SEQ ID NO: 1310 - DNA, 603 bp, Zea mays
atggagaacgtgcacgcggcgctggcggcggccgggctgggccacatcaaggtgacgacgtcggtgtcgcaggccatcctgggcgtgtacagcccgccgtccgccgcggagttcaccggcgaggcgcgcgggtacatgggccccgtgctgcagttcctggcccgcaccgggtcgccgctcatggccaacatctacccgtacctggcctgggcatacaaccccagcgccatggacatgagctacgcgctcttcacctcctccggcaccgtcgtgcaggacggcgcctacgggtaccagaacctcttcgacaccaccgtcgacgccttctacgtcgccatgggcaagaacggcggctccggcgtgccgctcgtggtgtcggagagcgggtggccgtccggcggcggcgtccaggccacgccggccaacgcgagggtgtacaaccagtacctcatcaaccacgtcgggcgcgggacgccgcgccaccccggcgccatcgagacctacctcttctccatgttcaacgagaaccagaaggagagcggcgtggagcagaactgggggctcttctaccccaacatgcagcacgtctaccccatcagcttc

SEQ ID NO: 1311 - DNA, 657 bp, Zea mays
atgtttgttgttcgtcgtcatcatcattatacatccttagccaccaccagacccgtacttcttgccgaagacaaccacctggagcttgtcgtacccagcaaggacaccagcaccagctacagcgcggaggatgtttgcgccagcacccttgaagagggacttggtaccctcctttgcgacaatctgcttgaaagcgtccaaggagctgttgtacttgacggcctcaccagatgtcatcatcatgcgacggcgaacagtgtcaatggggtaggaggcaaggccagcaccaatggttataccccacccgagcaagaagctggccaagaagttatcctgcagggtaccaacaagaagcactggcttcagggaatcatacataccaaagtaaagacctcggtacacaatgatccccacacaagagatattgaatccacggtagaggccacgaataccatcactggcaagggtcttgcggtaaacatcaacgagtccattgaactgcctctcaccacccttctttgcagccttggcatcattggccaaacgcgtacgggcgtagtcccagagaatagccaaagaatagagagcaagcaccagcagctccaccagaagccagatttccagcaaaccacttccagtacccatccttgtccttct

SEQ ID NO: 1312 - DNA, 1446 bp, Zea mays
atggcgctcacaagaatcggtcttgctggccttgcggtcatggggcagaaccttgccctcaacattgcagagaaagggttccccatctctgtgtacaacaggacaacctccaaggtggacgagaccgtgcagcgtgccaaggcagaaggaaaccttcccgtctacggcttccatgaccccgcgtcctttgtgaagtccattcagaagccacgggtggtgatcatgctcgtcaaggccggcgcgccagttgaccagaccatcgcgacgctcgcagctcacttggagcagggcgactgcatcatcgatggggggaacgagtggtacgagaacacggagaggagggagaaggccatggaggagcgcggcctcctgtatcttggcatgggtgtctctggaggagaggagggtgcccgcaacggcccgtccttgatgcccggaggctcgttcgaggcttacaagtacgtcgaagacattgtcctcaaggtggctgctcaggtccctgacagtggcccgtgtgtcacgtacattggcaaaggtggatcgggcaactttgtcaagatggttcacaacggaatcgagtatggcgatatgcagctgatttccgaggcatacgacgttctcaagtcggtcggtaagctcaccaacagtgagctgcaccaggtgttctccgagtggaacaagggcgagctcctgagcttcttgatcgagatcacggccgacatctttggcatcaaggacgagcatggcgatggctacctggtggacaaggtccttgacaagaccgggatgaaagggacagggaagtggacggtgcagcaggccgccgagctgtcggtggccgctcctacgatcgaggcgtccttggactcgaggttcctgagcgggctgaaggacgagcgggtggaggcctccaagatcttccagggtgactactactccaccggctcgccggtggacaaggcgcagctggtggaggacgtgaggcaggccctgtacgcgtccaagatctgcagctacgcgcagggcatgaacatcatcaaggccaagagcgcggagaaaggctgggggctcaacctcggcgagctggccaggatctggaagggcgggtgcatcatccgcgccatcttcctggaccgcatcaagaaggcctacgacaggaacccgggcctcgccagcctgctcgtagaccccgagttcgcgcaggagatcatggacaggcaggcggcgtggcgcagggtggtgtgcctcgccatcaacaacggcgtcagcaccccgggaatgtccgctagcctggcctacttcgactcctaccgcagggacaggctgcctgccaacctggtgcaggcccagagggactacttcggggctcacacctacgagagggtcgacatgcctggctctttccacaccgagtggttcaagattgcgcgcaacatctccaacaac

SEQ ID NO: 1313 - DNA, 1017 bp, Zea mays
atggcgaggcaacgacaagttgcttccatgcttgcagctgctctgctcgttgcaacgacgtttgcgtccattcctacaaccgtgcactccatcggcgtctgctacggcacgctgggcaacaacctgccgtccagcagcgacgtggtgcagctctacaggtccaagggcatcaaaggcatgcgcatctactcccccgacgccaaagccctcgccgccctgcgcaactccggcatcgcgctcatcctcgacaccggcaacggcggcggcgtcctgggccagctcgccaggagcgcctcgttcgcggactcgtgggtgcagagcaacgtgcggccctactaccccgccgtcggcatcaagtacgtcgcggtgggcaacgaggtgcagggcgacgacacgcgcagcctcctcccggcgatgcgcaacctggacgccgccctggcgcgcgccggcttcccgggcatcaagtgctccacgtcggtgcgcttcgacgtggtcgccaactcgttcccgccctccagcggctccttcgcgcagggctacatggcggacgtcgcgcgctacctggccggcaccggcgcgccgctgctcgccaacgtgtacccttacttcgcgtaccgggacaacccgcgcgacatcagcctgggctacgccacgttccagccgggcaccaccgtcagggacaacggcaacggcctcaactacaacaacctgttcgacgccatggtggacgccgtcgtcgccgcgctcgagaaggccggcgcgcccaacgtcagggtcgtcgtgtccgagagcggctggccctcggccggcggcttcggggccagcgtcgacaacgcgcggaaatacaaccagggactcatcgaccacgtcggccgcggcacgcccaagaggaccggcccgctggagaccttcgtcttcgccatgttcaacgagaaccagaagggcggcgatcccacggagaagaacttcggcctcttctacggcaacaagcagcccgtgtacccgatccggttcaac

SEQ ID NO: 1314 - DNA, 393 bp, Zea mays
atggatactaagctctcccatgctgagctgacacaccctgatgagcttgatgaggagtttgacacgttcccttcctccagaccagctgaaattgtaagaatgcgctatgacaggctgaggagcgttggaggtcgtgtgcaggctgtggttggggacctggcgacacaaggcgagagagcccatgctttgctgagctggagggaccctcgggccaccgccatcttcattttcttatccctggtgatcgccgttgtgctgtacgtgacgccgttccaggttttgatggtcatagccatgctttacctgctgcgacatccccggttccgcagcaggatgccctcagtgcctttcaacttctacaggagactgcctgccaagtctgatatgctcctt

SEQ ID NO: 1315 - DNA, 198 bp, Zea mays
atgagatccaagacgggcgcagcggggtgccgcccagcgacttccccaagtggctgccggccacccagcggaggctcctgcagcagacccagaagcctaacacggtggtcgcccaggacgggagcggcgacttcaagaccatcaccgaggccatcaccgccgtgcccaacaccttcgaggggcgcttcgtcatctacg

SEQ ID NO: 1316 - DNA, 633 bp, Zea mays
atggccgtgacggcggccggcccgtcgccgatgaccctggcgacgccaaagtcggcgaccttggcgccgagctgggcgtcgaggaggatgttgttggacttgacgtcgcggtgcacgatcggtggcccgcagtcgtggtgcaggtacgcgaggccctccgcggcgtcgaccatgatccggtgccgcgccggccagtccaggaggcatcccttgccgccgtggaggaggtcgccgaggctgccgttggccatgtactcgtacaccagaagccggcagtcgccgctgtggaagcagcaccacagcttcacgatgttcctgtgccggatcttgcccagcgttgccacctccacgtcgaagctttccttggcagtgctgcccgttgccttgccgccaccgctccacagcttcttgacggcaacggcgacgtcctcgccgccgcgcctcaggacggccttgtacaccttgcccgccgcgcccatgccgaccacgttgtcctcgtcgaggcagcccacgatgtcgtcctcgtcgaaccccaccttgtggaacgacgtcatcacccacctgggcttgccgccgccgtcgccgccgccaggctccgcggggtgtccaccgttgtggctccggtggtacgtg

SEQ ID NO: 1317 - DNA, 828 bp, Zea mays
atggccggggtcgttgtggtgttcgacttcgacaagacgatcatcgacgtcgacagcgacaactgggtcgtggacagcctcggcttcaccgagccgttcgagcgcctcctgcccaccatgccctggaacacgctcatggacaccatgatgggggagctgcacgcgcacggcaggaccctggacgacgtcgccgaggcgctccgtgcggcgcccgtcgtcgcgggcgtccccgccgccatcaaggccgcctacgcgctcggctgcgacctgcgcgtcctcagcgacgccaacgccttcttcatcgacaccgtcctggcgcaccacggcctgctgggctgcttctcccagatcaacaccaaccccagccaccccgacgccgacgccgacggccgcctccgcatcgggccctaccacgacctgcacgggtgcggcgtcggcacctgcccgcccaacatgtgcaagggccaggtgctggaccgcatcctccgcgaggcgtcgtcgtcggccgccggcaggaagcgcgtcgtgtacctgggcgacggccgcggcgactactgcccggcgctgcggctggcaagggaggacttcgtcatgccgcgcaggggcttccccgtgtgggacctcatctgcgaggaccccgcgcggctgcaggcggaggtgcacccctgggccgacggcgccgagctggaggagacgctgctgcgcctcgtcgggagggcgcgcgtggaggaggccgcactgctgccgccgctcgactgcaagctcgagtccatgcccgttgccgcgcaggagggcatgggacccatcatgccgctcggcgtcaagcac

SEQ ID NO: 1318 - DNA, 375 bp, Zea mays
atgcgtggcgaacctcggccggttggcgaacaccacgtcgtgctccgtgaagcactccttggcgcactcgggcgaggacacgaccagcgcgcggcgggaccccatgcgcatggagaacaccggcccgtggcgcgcggcgaggccggccagcgcctcgtggaacggcgtcttgacgaggtggaggtggccgaggaacgggacggccggagggctgggaggcaaccgctgcgttcccttgcccttgccattgcccttgcggccagcacgtcccacgaggtagtggatcacgaagaggaaggcgaaggagagcacggccacgtaggccttatccatggtcgtggtcgtggagcaggagatgttctggcccacgagctt

SEQ ID NO: 1319 - DNA, 450 bp, Zea mays
atggcggggatgacagtcggcaataagctggcgctggctgcggtgctgctgtgcgcggcggcggccatggccacggcgcagcaggcctccggcgtgcgcgccacctacaacttctacaacccgcagcagaacaactgggacctcaacgccgtgagcgcgtactgcgcgacgtgggacgccagcaagccgctgtcgtggcgcatgaagtacggctggacggccttctgcgggcccgccggccccaccggccaggccgcgtgcgggcagtgtcttctggtgactaacactgcgacgggggcgtccatcacggtgaggatcgtggaccagtgcagcaacggcggcctggacctggactacgacacggcgttcaagcccatcgacaccaacggccagggcttccaggccggccacctcacagtcaactaccagttcgtcaactgcggcgacaac

SEQ ID NO: 1320 - DNA, 1041 bp, Zea mays
atgggcggcgaactgctgcttgcgctcctcctcgtctctgctgctgccgcccctcaggtacttggagttggcaatggagacaatcacatgagaatcatccaggaggacatcattgagacagtcaacaaccatcccagtgctgggtggacagcctcacgtaatccttacttttcaaactataccattgcgcaatttaagcacatacttggagtgaaaccagcaccacagaatgcactaagcaatgttcctgtcaaaacttattcaagatcactggaacttccaaaagagtttgacgctagatctgcatggtcccgttgcagcacaattgggaacatacttgatcaaggtcactgtggctcttgttgggcttttggtgctgtggagtgcctccaggaccgtttttgcattcacctcaacatgagcattttactttcagtcaatgacctactggcatgctgcggttttatgtgcggcgatgggtgtgatggaggctatcctatagaggcatggcgctactttgttcaaaatggtgttgttacggatgagtgtgatccatacttcgacccggtcggttgcaagcatcctggatgcgaacctgcttatcctacaccaaagtgtgaaaagaaatgcaaggagcagaaccaagtttggcaggaaaagaagcatttcagcattgatgcgtacagaataaattcagatccacatgacataatggcagaggtctacaaaaatggtcctgtagaagttgctttcacagtttacgaggatttcgcacactacaaatctggagtgtacaagcacatcaccggtggcattatgggtggccatgccgtcaagttgattggatggggaaccagtgatgctggagaggattactggcttctggcaaatcagtggaatagaggctggggcgatgatggatacttcaagatcataaggggcaaaaatgaatgtggcatcgaggagggcgttgttgctggaatgccatcgacaaagaatatggttccaaacttcggcggtgccgttggaagagctatagtt

SEQ ID NO: 1321 - DNA, 1092 bp, Zea mays
atggcgggcacggtgacggtcccggggtcgtcgaccccctccacgccgctgctcaaggacgagctcgacatcgtgatcccgacgatccgcaacctcgacttcctggagatgtggcggcccttcttccagccctaccacctcatcatcgtgcaggacggcgacccgaccaagaccatcaaggtgcccgagggcttcgactacgagctctacaaccgcaacgacatcaaccgcatcctcgggcccaaggcctcctgcatctccttcaaggactccgcctgccgctgcttcggctacatggtctccaagaagaagtacatctacaccatcgacgacgactgcttcgttgccaaggacccatctggcaaggatatcaatgctcttgagcagcacatcaagaacctcctcagcccatccaccccgttcttcttcaacaccctgtacgacccctaccgtgagggtgctgactttgtgcgtggataccccttcagcctcagggagggtgctcacaccgccgtctcccacggcctgtggctgaacatccctgactatgatgctcccacacagctggtcaagcccaaggagaggaatgagaggtatgttgatgctgtcatgacaatccccaagggaaccttgttccccatgtgtggcatgaaccttgccttcgacagggatctcattggccctgctatgtactttggtctcatgggtgatggccagcccatcggtcgctacgacgacatgtgggcaggatggtgtgtgaaggtcatctgcgaccacctgagcctgggagtcaagactggcctgccatacatctggcacagcaaggctagcaaccccttcgttaacttgaagaaggaatacaagggcatcttctggcaggaggacatcatccccttcttccagaacgtgaccatccccaaggactgcgacaccgtccaaaagtgctacatctacctctctggacaagtgaaggagaagctgggcacgattgacccctactttgtcaagctcggtgacgccatggtcacctggatcgaggcctgggatgagctgaacccgtcgacccctgccgccgcaaatggcaaggccaag

SEQ ID NO: 1322 - DNA, 981 bp, Zea mays
atggagaccatcgcgcgcaccaagacgtcccgcgccgaggcggacgccgactcggacatgtcgcccgaggcgcacgaattcaagcagatcgtcgacgagatcgtgccgcacctcggcacggccaacctgtgggactacctgccggtgctgcggtggctcgacgtgttcggcgtgaggaacaagatcacggccgctgtgggcaggagggacgcgttcctgcggcggctcatcgacgcggagcggcggaggctggacgacggcggcggcgacagcgacagcgacaagaagagcatgatagccgtgctgctctcgttgcagaagtcagagccggaggtgtacacggataccatgatcatggcactttgcgggaacttatttggcgccggaacggagaccacgtcgaccacgacagaatgggccatgtcgctcctcctgaaccacccggaggcgctgaagaaggcacaggcagagatcgacgcagtcgtgggcacctcccgcctactcgccgcagaggacgtgccccgactcggctacctgcaccgcgtcatcagcgagaccctgcgcatgtacccggccgccccgctgctcctgccgcacgagtcgtcggcggactgcaaggtcggcggctacgacgtggcccgcggcacgctgctcatcgtgaacgcgtacgccatccacagggacccgctggtgtgggaggacccggacgagttcaggccggagcggttcgaggacggcaaggccgaggggcggctcctgatgccgttcgggatggggcggcgcaagtgccctggggagaccctcgcgctgcggaccatcagcctggtgctcggcacgctgatccagtgcttcgactgggaccgagtcgacggcctcgagatcgacatggccgcgggcggcgggctcactctgcccagggccgtcccgttggaggccacgtgcaagcctcgtgcagctgtgcgccatcttcttctggagctc

SEQ ID NO: 1323 - DNA, 363 bp, Zea mays
atggtctggagctgtaccatccccggcaagcaggggactgattgggaaagtgggtactacccacttacccttcatttcagtgaagattacccaagcaagcctcccaaatgcaagttcccacagggttttttccacccaaatgtttatccttcaggaacagtctgcctctcaattctcaatgaggatagtggttggagacctgctatcactgttaagcagattctagttggaatacaagacttgcttgatcagcccaatccagctgatcctgcccaaactgatggttatcacctattcatccaggatccaacagaatataagcgacgtgttcgtctgcaggccaagcaatatcctgctctggtc

SEQ ID NO: 1324 - DNA, 768 bp, Zea mays
atgccccggcgctcgggcgtccgcgccgggtccacggtcagctcgccgtggatgcgcagcccggcgatcacctcggggaagcagtgcacgcggcggtcggcgctgaagtcgatcggcgggaactccgacagctgggacaccacgtcgccgtacttggtcatccaccagtcgtggtactcgaggatcaccagcgccacgcgccgccggaggtggcgcgccgtcacgaagagcggcaggatgccgtcgttgaactcgtggtacacgttccccgtgtacccgccggtggagaacaccacggccggtacgtcgtggcgcacgtcgcaccgcgcggcgtcgccgggggccacgcggcgcagccgcacctcgtcgatcgtcgccatcacgttcgcctcccacttgcgcgtgtacggccgtatccgctcccccggcgtcgagttgccggtggacacgagctggaacgacgcgctggccgagtgcatgcgcaagtcccccctcgcgaagcagatgtccgcgcgctccgacgtgcggtcgcagcagaggctgttgttccccacggccgagcacggcccggacaccccgccgcgcgcggccgtggccgccgccgccgcgccgccttcatcgctatgcacgaaggagaggaaggacacgggcgccacgaacagcgtccccacgcagaggaaggagagcaggagcatggccaagaagcgccgcacgccgagcgccctgggttgcaccgtcttgccgctcttgccaccgccgccgctgccg

SEQ ID NO: 1325 - DNA, 840 bp, Zea mays
atggcggctaatctcaagtgggctcctgttctagccctcgtcgtcgtcgttgctgccatggttggcaccacgagcgccggcaacatcgcagtgtactggggccagaacggcaacgaaggcagcctggcggacgcctgcaactccgggctctacgcctacgtcaacatcgcgttcctcacaaccttcggcaacggacagaccccagtcctcaacctcgccggacactgcgaccccggctctggcagctgcaccggccagagcagcgacatccagacctgccagtcgctgggcatcaaggtgctcctctccatcggcggcgccagcggcagctacggcctctcctccaccgacgacgccaacagcgtggccgactacctgtgggacaacttcctgggcggcagcggctcgtcccgcccgctcggcgccgccgtgctcgacggcatcgacttcgacatcgagaacggccagtcggcgcactacgatgacctggcgaacgcgctcaagggcaaggggagcgtgctgctgacggcggcgccgcagtgcccctacccggacgcgtcgctggggccggcgctgcagacgggccagttcgacaacgtgtggatacagttctacaacaacccccgggtgcgcgtacgccaacggggacgacaccaacctggtgaacgcatggaacacgtggaccagcagcatcaccgcggggagcttctacctcggcgtcccagcgtctccccaggccgcgggcagcgggtacatcgaccccggcaccctgacgggcacggtgatccccgccatccgaggcattggcaactacggcggcatcatggtgtgggaccgctt

SEQ ID NO: 1326 - DNA, 1137 bp, Zea mays
atgaacaccaccgacgtcggcaagcagttcaccatgtccgaggtgcgcaagcacgcgtcgcaggagtcggcgtggatcgtcgtgcacggccacgtctacgactgcaccaagttcctcaaggaccacccgggcggcgccgacagcatcctcatcaacgccggtaccgactgcaccgaggagttcgacgccatccactccgacaaggccaaggcgctcctcgacacctaccgcatcggcgagctcatcaccacgggcaccggctacagctccgacaactccgtccacggcggctccgtcctgtcgcacctcgcgcccatccgcgaggccgtcagggctcccgcgctctccaacccgcgcgaaaagatccactgccgcctcgtcggcaagaaggagctgtcccgcgacgtccgcctcttccgcttctcgctgccgtcgcccgaccaggtgctcggcctccccatcggcaagcacatcttcgtctgcgccagtattgaagggaagctgtgtatgcgggcgtacacgcccacgagcatggtggacgagatcggccacttcgacctcctcgtcaaggtctacttcaagaacgagcaccccaagttccccaacggcggcctcatgacccagtacctcgactcgcttcccgtcggctcctacatcgacgtcaagggcccgcttggccacgtggagtacaccggccgcggcagcttcgtcatcaacggcaagcagcgccatgcgagccgcctcgccatgatctgcggcggaagtgggatcacgcccatgtaccagatcatccaggcggtgctgcgcgagcagccggaggaccacacggagatgcacctcgtgtacgccaaccggacggaggacgacatcctcctccgcgacgagctcgaccggtgggcggccgagtacccggacaggctcaaggtgtggtacgtcatcgaccaggtaaagcgcccggaggaggggtggaagtacagcgttgggttcgtcacggaggccgtcctgcgggagcacgttccggaaggtggggacgacacgctggcccttgcctgcggaccaccgccgatgatccagttcgccatctcgcccaacttggagaagatgaagtacgacatggccaattctttcgtcgtgttc

SEQ ID NO: 1327 - DNA, 450 bp, Zea mays
atggccaccgtcctaggcagcccccgcgcgccggccttcttcttctcgccgtcctccctccgtgccgcgccggcgcccaccgccgtggcgctgcctgcggccaaggtgggcatcatgggccgtagcgccagcagcaggggcaggctgcgcgcgcaggccacctacaacgtgaagctgatcacgccggagggggaggtggagctgcaggtgcccgacgacgtgtacatcctggaccaggccgaggaggacggcatcgacctgccctactcctgccgcgcggggtcctgctcctcctgcgccggcaaggtcgtctccggctccgtggaccagtccgaccagagctacctcgacgacggccagatcgccgccggctgggtgctcacctgccacgcctaccccacctctgacgtcgtcatcgagacgcacaaggaggaggagctcaccggcgca

SEQ ID NO: 1328 - DNA, 648 bp, Zea mays
atgagtaagttgcagtctgagtctgtcaaggatgccatctcccagattgttggggatgccaaggagaagaataggaagttcactgagactgtggaacttcagattggtctgaagaattatgatccacagaaggacaagcgtttcagtggctctgttaagttgccccatatccctcgtcccaagatgaaggtgtgcatgcttggtgatgcccagcatgttgaggaggccgagaagatgggacttgactacatggatgttgaggctctcaagaaaatgaacaagaacaagaagcttgttaagaggcttgccaagaagtaccatgctttcttggcatcagaggccatcatcaagcagattccccgtctccttggtcctggtctcaacaaggcaggcaagttcccgaccctggttactcaccaggaatccctcgagtccaaggtgaacgagactaaggcaaccgtcaagttccagctcaagaaggttctttgcatgggtgttgccgttggcaacttggcgatggaggagaagcagatccagcagaacatccagatgagcgtcaacttccttgtttcccttctgaagaagaactggcagaatgtgagatgcctctacgtcaagagcaccatggggaagccatacagggtgttc

SEQ ID NO: 1329 - DNA, 552 bp, Zea mays
atgcacgtggcgtggatgcccgtcgagccttggtcaagcaaagaagccattagtgctagtgttagcggcgggcatgtgcggcatctgggccgcctggatgctctgcaggaacatcctctcctccgccgacgcggcgaacccgtgggaggcggcgggggcgaagacgtcgccgccgtcttgcagcaggccgccgccgccgccgttgctatagccgaatggcgacgccgcgccggcgtactgctgctgctgctgctgcctgcggagctgctcctggagcggcgcggggtgctggctccggtgcagctggtggtcgaaggacatgacggcggccgaggacggcgggaagccgtagtcggcggcgaagttgatgaccggggccccgaacgcccccgcggggggcgcggggatgcccgtgaactgctgcaccatggcacggaagttggccgtgtccgtgttcagcagcgtcacgggcgcgcgccgcgacgcgcgggaccgccgccgtcgtcgtcggggggcagcaggaccggcccggcgtcgtggtggtggtggtgg

SEQ ID NO: 1330 - DNA, 1320 bp, Zea mays
atggagaggggcggcggcggcggagacgagatgatgatgacctcgggcgcgacgggccggatcgtgccggtgttccgctccgtgctgtcgcggcgcgctctgctccgcgtcgccgtggcgctgcactcgctcttcctctggctgctgctcctcgcccgcggcctccgccggcaccgggcggggaccggcgccgacgcgtcggcgtcggaggcgggggctggggccgggacctggagcgcgcggcggtggcggctgcggctgcaggccgcggaggaggaggacgtgcgccgccgcagggcgctcgcggaggaggtgcccatggaggaggaccggggcactaggtgggccaccttcctcgtcaccggggccaggaggaacgcgcttttctgccgactctgggcgccggacggcgacgagatgaggggcattttggtcatcatacatggcttgaatgagcacagtggaaggtacgtgcactttgctgagcagctgacagcatgtggtttcggagtatacgcaatggattggatagggcatggtggaagcgatggcctgcacggctatgtgccttcactagattacgtcatcgaagacatcgaagtgcttgttgacagaattctgatggagaatccaggggtcccttgtttcctcctcggccactccaccggtggggctgtcgtcctgaagggagaaactggaaggcatcgttctgacatcgcccgcgctgcgtgtgaagcctgcgcatcctattgttggggctgtggcgccgatcttctctctggtggcgcccaggttccagttcaagggcgccaacaagaggggcatcccggtgtcccgcgaccccgcggcgctgctggccaagtactcggacccgctggtgtacacggggccgatcagggtgcggacggggcacgagatcctgcgcatctcctcccacctgctgcaccgtctggagaaggtcaccgtcccgttcctggtgctgcacggcaccgccgaccgggtcacggacccgctggcgtcgcgcgagctctacggcgcggcggcgtccgcgcacaaggacctgcgcctgtacgacgggttcctgcacgacctgctcttcgagcccgagcgcgacgaggtcggcgccgagatcgtcgcctggatggacgggatgctccggctccggcggcaggctggatgaagggatggccgtgctgcttctctccttctaggtggtgttcctctccaaagtataataatagatttgtgtgccaagataagatggatgcatttgtgctgtggaactacgttacgtatctatttatatttataacagcgggg

SEQ ID NO: 1331 - DNA, 513 bp, Zea mays
atgggacctgccaggcagggccaagatgggggagaaggagtggtacttcttctgccacaaggatcgcaagtacccgacgggcacgcggaccaaccgcgccacggagaccggctactggaaggccaccggcaaggacaaggagatcttcaggggccgcggcgtcctcgtgggcatgaagaagacgctcgtcttctaccgcggccgcagtggttgaaggcgctcgtggccgactgcgccacgcgcagctgcacgcgcctgctgcttcagtcgggcgaggtggccgcgcggggggggctccagcacgacctcgccatgctgcacgacgtgctccccgccgcggagctcgggctcgccgacgacagcgcccgcgtcgcggcagtgccgccgcgcggcggccccggagctggagctaaaggcaggcgtgctcgcgctgatccaggaggtggagcgggagggagcagagggcaggggaggcgcggttggaagggcaccggcgggcggcggctggtaggg

SEQ ID NO: 1332 - DNA, 381 bp, Zea mays
atgactcacggccgggagaggaggtacgagctgttcgacaggtggtggcatgagaagggatgcactggcgctggcggtggcatcacgtcctccatgtcggcagcgtcggcgagcagccggagacgcagcaaatacgccgggctaacgcaggacccgtgcttctgggcgagagtggaggaggcgagggagcagacggagagcgcacgccgcgagcgcgacgtggccgaactggcgatgaagctggaggagctgcaagagttcgagcgctactcccgtgagctggtggcgaccaaggaggtgtccgtcgacgtgctcgcgccgcagtcgagctacacgctgtgggtggaggattggaaccagctcaagctcagggctcaggga

SEQ ID NO: 1333 - DNA, 411 bp, Zea mays
atggctgggaagggaggaaaaggattgctcgccgcgaagacgacggcggccaagtcggcggagaaggacaaggggaagaaggcccccatctcacggtcctcccgcgcgggcctccagtttcctgttggacgaatccaccgtcagctgaagcaaaggactcaggcaaatggccgcgttggtgccactgcagccgtctactccgccgccatcctggagtacttaactgccgaggttctggagctggctgggaacgctagcaaggatctgaaggtgaagcgtatcacccctcgccacctacagttggccattcgcggagacgaggagctggataccctcatcaagggcaccatcgcaggtggaggcgtcatcccgcacatccacaagtccctgatcaacaagtcctccaaggag

SEQ ID NO: 1334 - DNA, 336 bp, Zea mays
atgggcttcgagaagcagatcctgagatccggcaccggccccaagccgataaagggccagaaggtcaccgttcactgcaccggctacgggaaggatcgtgatctgtccaagaaattttggagcaccaaggaccctgggcagcagccattcagtttcagcattggtcagggttcagtgatcaaaggatgggacgagagagttatgaccatgcaagtgggtgaagttgctcgtatccagtgcacgcctgattatgcttatggagccggcgggttcccagcctggggaattcaaccaaactcagtgcttgtgttcgagattgaagtcctcagtgcccag

SEQ ID NO: 1335 - DNA, 651 bp, Zea mays
atgattgcaaaattctcatcaatatctactcgaaagctatcgaaggcattgtcagcgctcacccgtgacaaaactatggttgctacaagtgactatggtgacttccacaaaatgattaagcgttatatcatgacattcatgttgggtacttctggccagaaacaatttagggacacaagaaacatgatggttgacaacatgttgaacactttccatacattgttgatggatgatccaaattctcctctgaacttccgggaagttttcaagaatgaattatttcgcttatccctggttcaggctttaggcgaggatgtgagttcaatctatgtggaagagtatggaaaggttatatcaaaggaggaaatctacaaggccactgtggttgacatgatgatgtgtgcaattgaggtcgactggagggatttcttcccgtacctcagctggattccaaataggaccttcgaaacaagagtactgactaccgaagcgaggagaactaccgtgatgcaagccttgatcaagcagcaaaaggaaagaattgcacgtggggagactaggatatcctacctggacttcctgctggcagagaatacactgactgatgaacaattactaatgctggtgggggaaagcagtcatagaagctgc

SEQ ID NO: 1336 - DNA, 906 bp, Zea mays
atggggggttttgtcaagacccacaagaccaatgcgtacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatctctgctagtatagcaggtgatatggttcttgcttctgcttactcgcatgagttgccacgatatggtcttgaagttggtctgaccaactatgcagctgcctactgcactggccttctgttggctcgccgtgtgctcaagacccgtggtttagataaggaatatgaggacaatgttgaggccactggtgaggacttctctgttgagccagctgatgagaggaggcctttccgtgctctcttggatgttggccttattaggactacaactgggaaccgtgtctttggtgccctcaagggagctttggatggtggactggatattcctcacagcgagaagaggtttgctggtttcaagaaggatgacaagcagctggatgctgatatccatcgcaagtacatctatggtggccatgttgctgactacatgaggaacctcgctgaagaggagccagagaagtaccagtctcacttcagtgagtacattaagaagggaattgaggctgatgacatggaagctctgtacaagaaggtccatgctgccatccgtgctgatccttctgtggtcaagtcaaccaagcagccaccaaaggagcacaagaggtacaaccccaagaaactgacatacgagcagaggaaggccagtctcattgaaaggctcaaccaactcaactcctcgggcggcgcagatgacgacgatgaggatgacgag

SEQ ID NO: 1337 - DNA, 750 bp, Zea mays
atggcggcgtacgagaagcagcggccggaggctccgatgaacgccgcgtactacggccagccgatccgtccgctgcagccgccgtactatccaccgccgccgccgccaccgccaccaccacaaggtccaccaccgccacgacccgtcccacgccttggcggcggcccgcgctgcctgctcggctttctcgtgacccttatcgtcgcgatcggcgtggctaccctggtcctacggctcatctcgcgcccgtacagcctcaaggcgtacgccgactccgcggcgctctcccgtttcgatctcggcagcggcagcagcggcggaggggacgacctcctccagtacaacctcaccgtggacatccgcctgcggaaccccagccgcttcggggtccgctgcgactacgccgaggcgcaggcgttctacggcggcgaccgcttcgggttcgacccgctgcggccgttctacctggacggcaggagcgacgccagggtcacggccacgttcggcggctcggcggtggtagacggcgacggcgcgcggcgcacgtaccagagggagagcggggaggggttctactacgtcaaagtgaaggtgtacgcggacctcaggttcagggttaggacgatcgtccgccggcgtgttttcaagagcaagatcacctgcgtgctgcgcttgcctgtgcccgctgccggtggcggcgtcaactccacggcgatgacaacgctagggacgaggtgcgacgtagacttc

SEQ ID NO: 1338 - DNA, 207 bp, Zea mays
atgcgtggtgtgcgtatcaagaagcatgcctgcatctcgaacagcattatcgggtggcactcaactgttggacaatgggcacggatagagaatatgaccatcctgggcgaggatgttcatgtgtgtgacgaggtatacagtaatggcggtgttgttctcccacacaaagagatcaagtcaagcattctgaagcctgagatcgtcatg

SEQ ID NO: 1339 - DNA, 366 bp, Zea mays
atgtcccccgagcggttcgacccggaggcgtactcgggagactacgacccctacgccgccgacgtgtggagcctcggggtggccatcctggagctgtaccggggccacttccctctcctgcccgcgggccagcgcccggactgggccgcgctgatgtgcgccatatgcttcggcgaggcgccggagccgccggccgcggcgtcggaagagttccgggatttcgtggcgcggtgcttagagaagaaggccgggcggcgcgcgtcggtggccgagctgctggagcacccgttcgtcgccgagcgggaagcggccggcgcacaggaggcgctcgccgcgctcgtgaaagaggcggagcagctggaccta

SEQ ID NO: 1340 - DNA, 423 bp, Zea mays
atgtcaatttcccggtcaaaccttccaaatcttctaagagcaggatcgatgctgtttggccggtttgtagcacccataacaataacatgggaacgagatttgagtccatccataagagtcagtagctgtgaaacaatacgacgttctacttctccattggtcttttctctcttgggtgcaatggaatcaatttcatcaatgaaaatgatagatggagcattcttctctgcttcttcaaatgcctttctgagattgctctcactctctcctgctaacttcgacataatctctgggccattgatcagaaagaaaaaggctccagtctcattagcaacagcacgagcaataagagtctttccagaaccaggtggcccatacagcaatatgccctttggtggcttcacaccaatagatttgaaaagc

SEQ ID NO: 1341 - DNA, 168 bp, Zea mays
atgacgtcggccacgccgcagcgaggcgcgaccatctgcgagacggtggacgggtccagcgcgccggtggcgttgagcccgaagttgcgctggtacgtcgcgatggccgcctccaggttctggtcgaacgcgtcgctgaagggggacgacggcggcggcggcgggagg

SEQ ID NO: 1342 - DNA, 393 bp, Zea mays
atggtggtgaagatgtgggcgccgcaggtggaggtgctgcggcacgcagccacgggcgcgttcatgacccactgcgggtggaactcggtgctggaggcggcgtcggccggcgtccccatgctgtgctggccgatgtacgccgagcagagggtgaacaaggtgttcgtagtggacgagatcaaggccggggtggtgatggacggctacgacgaggagctggtgagcgcggcggaggtggagaagaaggtgaggctggtgatggagtctgaggaaggggagaagctcagggagaggctggcgttggcaaaggagaaggcggcagaggcgctggctgatggcgggccgtcgcggatggcgtttgaggagttcttgaaggatatcatgctcgccaaa

SEQ ID NO: 1343 - DNA, 339 bp, Zea mays
atgcgctcgctggggcaaaatcctacagaggctgagctccaggacatgatcaacgaggtcgatgctgatggcaacggcaccatcgatttcccagagtttctcaaccttatggctcgcaagatgaaggacaccgactctgaggaagagctcaaggaggccttccgtgtgtttgacaaggaccagaacggcttcatctcggccgccgagctccgccatgtcatgacaaatcttggtgagaagctaactgatgaggaggtggacgagatgatccgtgaggctgatgtcgatggtgatggccagatcaactacgaggagtttgtcaaggtcatgatggccaag

SEQ ID NO: 1344 - DNA, 762 bp, Zea mays
atggggagggacgagaggttcccagtgtgggaggccgcgctcggcgctggggtcgccgccgccttcgccgctgggctcgtcggggtttacctttccatgccggactccgactacagcttcctcaagctgccacgtaatctccaggaactccaaatcctcactggccatcttgagaactatactagcgactacaccctacaggtgttggtaggctactgcgccgtgtacatcttcatgcagaccttcatgatcccaggaacgatattcatgtcactgcttgctggtgctctgtttgggcagctccggggcgtggccctggtagtcttcgccgccactgctggcgcttcttcgtgctatttcctgtcgaagatgattgggaagccactggtgttcacgctgtggccagataaactcagcttcttccagagacaggttgctaaaagaagagagaagctcttgaattacatgcttttcctcagggtgaccccaacattgccaaataccttcatcaacttggcttcaccgatagtagatgtcccctaccacatattcttactgggaactctcattggccttatcccagcttcttatgtgactgtcagggctggaatcgctcttggagaattaacttcgctaagcgacctttacgacacccagtcgatagcgctgctattcctgatcggtgttgtttcagtcacaccagcattgttgggcaaggacgaggcacaagaaaaaccatcagaaatggctgtaggcgcgtcg

SEQ ID NO: 1345 - DNA, 582 bp, Zea mays
atgcctactgcactagaaacgtgtattctgggggtttggagatggatctacaaataccctgtctacgatactccgattggaaaaatgggtgctctcatttgctgggaaaacagaatgccacttctcaggacggccatgtatgccaaaggtattgagatatattgtgctcccacggttgattgcatgccaacttggctgtcttctatgacacatatcgcccttgaagggggatgctttgtgctgtcagcgtgccagttctgtcgtagaaagaactaccctccccctcccgagtacacattttgtggcctagaggaagagccatccccggaatccgttgtttgttctggagggagtgtcatcatctcaccattgggaacagtgttggcgggtcccaactacgaaagtgaggcccttctcactgctgacctggaccttggagagattgttcgagccaagtttgattttgacgtggtgggccactactcgcgacctgaggtgctgagtttagtggtgaagagcgatccaaagcccgccgtctctttcatctcagccgctggtagggacgatgactatgtgcagacc

SEQ ID NO: 1346 - DNA, 642 bp, Zea mays
atggcgaggatccacctctacgtcgtcgccgcggcctgcgccgtcgccctcgcgctcgccggcgacccggacatgctccaggacgtctgcgtggctgactacgcttccccggtcaagctgaacgggttcccgtgcaaggcgaacgtctcggcggacgacttcttcttcgacgggctgaggagcccgggcaacaccaacaacccggcgggctccgcggtgacggcggccaacgtggacaagttcccgggggtgaacacgctgggcgtctccatggcgcgcatcgactacgcgccgggcggccagaacccgccgcacacgcacccgcgcgccaccgagatcatcttcgtcctcgagggcacgctcgaggtcggcttcctcaccaccgccaacaggctcctcagcaagaccgtcgccacgggggacgtcttcgtcttcccccgcggcctcgtccacttccagcagaacagggggcacggccccgccgccgtcgtcgccgccttcaacagccagctccagggcacgcaggccatcgccatgacgctcttcggggccacgccgcccgtgcccaccgacatcctcgccaaggcattccgggtcggcagcggggaggtcgagcacatcaaggcaaacttcgcacccaag

SEQ ID NO: 1347 - DNA, 696 bp, Zea mays
atgatgcagccgccgccgccacatcagcagcagcaatgggcaatggcgcccccgcccccgccgcagtactaccaggcggggcaccctccgccgccgcccccgcagttctaccaggcgggccctccgcctcccgctatgtggggccaaccgccaccgcaggcggcggcggcgccggcgccggccggcggcggggcgggggacgaggcgaggaccctctggatcggggacctgcagtactggatggatgagaactacctctatagctgcttctcccaggctggcgaggttatttccgtgaagataattcggaacaagcagactgggcaacctgagggttatggttttattgaattcagcaaccatgctgtagccgaacaagttctgcagaactataatggtcaaatgatgcccaatgttaatcaacctttcaaattgaattgggctaccagtggggctggtgagaaacgtggagacgatggttcagattatactatatttgttggggacttggcctcggatgttacagatttcattctacaagatacgttcaagagtcgttatccatcagttaagggtgcaaaagttgtctttgacagaactactggccgttcgaaaggctatgggtttgtaaaagtttgcagattcggatggaacagacaccgggcaatgactgaaatgaatgggacaatactgttc

SEQ ID NO: 1348 - DNA, 378 bp, Zea mays
atgtcgtcgatgatgaacgcgctggcgaactggctggcgaacccgcgccgcaacccgctggcgcgcctccacatgcacgccgtctcctcgcgcctcaggaaatacggactgaggtacgacgacctctacgacccctacttcgatctggacatcaaggaggcgctcggtaggctgcctagggaggtggtcgacgcccgcatccagcgcctcaagcgtgccatggacctctccatgaagcaccagtacctcccggaggacctccaggcacagcaggttccattcagaggatatttgggtgacatgttggcgttggtgaaaaaggaaagcgccgagcgtcagtcactgggagcccttccactataccagaggacacttccc

SEQ ID NO: 1349 - DNA, 309 bp, Zea mays
atgacggcgctgctgatcctcttaaacagctcgtacagcgcctcgacctcactcacgctgaagacggtctccctcgcgaggacctgggggtcttggagcccccgcggctgcttgagctcgacgtcgcagcaattgagcaggaccgcgagcagctgcctcaccccgtccaggcactgcaccatgatatgccctcgccaccgcccaccggctccccacgccactcaccggtcactgccccatcccacggccgcgcggagggctcggctcctcgagggacggagggagggacgggattgtgggaatgggggg

SEQ ID NO: 1350 - DNA, 666 bp, Zea mays
atggcggacttggccttttgcatccacatagtggcactcttcctatacttatccttactatcaccatccatgacatccttgatgcacctttccacctcgtccctcgttaccaagcctttctcatccttgcgcacccggacacccaagccccacatgctctccatatattttgatatggtcggctggtctgcccagtgtggtattgccaccattggcacaccattaacaattgcttccagtgtcgagttccatccgcaatgtgtgaagaaacaacctgtagctttatgtgctagaacttccagttgggggcaccaagaaacaataaggccacgttccttgcacttgtcacgaagttcatcggacaacttgtgttcttcgtttgacctcacaacccaaatgaatggtttgccagaattgtacaatccattgccaagctcctctaacttgggttcgatctcgtggaatgagttgacgagcacgtcgtcggcgtcctccagcccctcaaattgccgcagtgatgcccgaaggaacacagggcaccagtctggctttgctgcgaacggcggaacgtcgtcgggaccaagctcgacacccagcagcccgcgtgcaaacagctctttcccgtccaccaccggcagtggcagccgtcctgcccacacctccccg

SEQ ID NO: 1351 - DNA, 834 bp, Zea mays
atgtcttccatggagctgctccacgccgtcgtcccggagaagcagagcgaggaggaggtcgcgcccgcagcgacgaccacgagcagcagcgccaccgccacgggcggggacgagggcgcccacgtgccccaggggtgggccaagaggaagcgctcgcgccgccagcgatcggaggaggagaacctcgcgctctgcctcctcatgctctcccgcggtggccaccaccgcgtccaggcgccgccaacgccggtcccgtccgcggcgccggccgccgcggagttcaggtgctccgtctgcggcaagtccttcagctcctaccaggcgctggggggccacaagaccagccaccgggtcaagctgccgacgcctcctcctcctcctactgccgccgctgtaactgtctcggcagcagtgcccgtcccggaggcccccgccccgatcaccgtcgtcgtcccgccgctgccgccagtcgaggtcggccgcgagccggccacgtcatccaccgccgcgtcctccgacggggcggcctcgagcagagtccacaggtgctccgtctgccacaaggagttcccgaccggccaggcgctcggcgggcacaagaggaagcactacgacgggggcgtcggcagcgccgccgcgtccaccgacgtcccggcggcgcccgccgagacgtccgccgaggtcgggagctccgccgcgcgtgcgttcgacctcaacctcccggccgtgccggagttcgtgttccggtgcggcaagcccggcaagatgtgggaggaggacgaggaggtgcagagccccctcgccttcaagaagccccgcctcctcatgaccgcg

SEQ ID NO: 1352 - DNA, 750 bp, Zea mays
atgaggttcagctgcagcacaggggatgccatggggatgaacatggtctccaaaggtgtacagaacgtgctggactacctccaggctgacttccctgatatggatgtcatcagcatatcaggtaacttctgttctgacaagaagtcagctgctgtgaactggatcgatggccgtgggaagtcggtggtttgcgaggcggtaatcaaggaagaagttgtgaaaaaggttctcaagacaaacgtacaggctctcgtagaattgaacgtgatcaagaaccttgccggttcagctgttgctggagctcttgggggtttcaatgcccatgcaagtaacattgtggcagccatcttcattgctactggtcaggaccctgcacagaacgtggagagttcccagtgcatcaccatgttggaagctataaatgatggcaaagatctccacatctctgttactatgccatctattgaggttggcacagttggtggaggcacgcagctggcctcacaatctgcctgcttggacctgcttggcgtcaaaggtgccaacagggaatctccggggtccaacgcgaggctcttggcccacgtggttgcggggtgcggtcctagctggggagctgtcccttatctctgcgcaggccgctggccatctggtcaagagccacatgaaatacaacagatccagcaaggatatgtccaagacccttgcagaggaaacagacaaacccaagaaatgctgaataatatcaag

SEQ ID NO: 1353 - DNA, 435 bp, Zea mays
atgagcgccgaggcgattcggagcgcgttcggcgcggccgaggaggagttccataggcaggtgaggcaggagtggaggagccggccgcggctcgctgccgtgggctcctgctgcctgctcggggccatctccggggacacgctgtacgtggccaacgccggcgattcccgcgccgtgctcggccgtcgagtgcccggcggcggggcggccgtcgccgagcggctctccgccgagcacaacgcggcgtgcgaggaggtgcggcgcgagctcgccgcgctcaaccccgacgacgcgcagatcgttgtgcacgccaggggagcctggagggtcaaggggataattcaggtgtcgagatccattggcgatttttatctcaagaaaccggagtatagcctggaccccttgttccggcaagttgggggccccctattgcgc

SEQ ID NO: 1354 - DNA, 888 bp, Zea mays
atgtatgacgagttggctagcaagagcaatgttgaatatattgccggaggagccacccagaactctatcagggttgcccaatggatgcttcaaactcctggtgcaacaagttacatgggatgcattggaaaggacaagtttggtgaggaaatgaagaaaaacgctcaagctgcaggagttactgctcattactacgaggatgagactgctcctactggcacatgtgctgtatgtgttgttggtggtgaaaggtcattgattgcaaatctgtcagcggcaaactgttacaaatctgagcatctaaagagaccagagaactgggcactagttgaaaaggcaaaatacatctacattgctggatttttccttacagtgtcgcctgattctatccagctagtcgctgagcatgctgcagcaaataacaaggtgttcctgatgaacctctctgctcccttcatttgtgagttcttccgtgatgcccaagagaaggtcctcccgtatgctgactacatcttcggcaacgaaactgaggcaaagatctttgccaaagtcagaggatgggagactgagaatattgaggagattgctttgaagatctctcaacttcctttggcttcaggcaagcaaaagaggattgctgtgattactcaaggtgctgatccagtggttgttgctgaggatgggaaggtgaaaacgttccctgtgatcctattgcccaaggagaagcttgttgacaccaacggcgcaggtgatgctttcgttggaggcttcctctcacagttggttctaggcaagggcattgaagactgcgtgagggcaggttgctatgccgcaaacgttatcatccagcgcccgggctgtacttacccggagaagcctgacttcaac

SEQ ID NO: 1355 - DNA, 495 bp, Zea mays
atgggtgcacccgagcacaacggaagcaggcgggatgaggcacctgtttggaggcgctggaaaccggaacgcgaacgggcggaatcttcgccgccgaccttgcgcggtggctgcgggcaaacgctgggcaccgacgcccccgccggtatcggcggaggaagccggagccgctggtggccgggcgcggacgcggacggcgacgggctgctggaccccaccgagttcgcgcggctcgtggccggcctgcacgcgggtgccgccgaggaggaccgccaccgctgcctgcgccaggccttccggatgtactcctccgacgacgacgcggcggagggccggggctcctcctgcatcacccccgacagcctgcgccgcatgctcgccaggctcggcgcgcaccaggacgtggacgactgccgcgccatgatctgcaggttcgacctcgacggcgacggcgtgctcagcttccacgagttcaaggtcatgatgggcgccgcg

SEQ ID NO: 1356 - DNA, 381 bp, Zea mays
atgaccttaacgtctgggcacagagcaaaatttgaatccacatactggagattgacaaccgatccagtactaataacagactccactctagtctcccttccggcggaaagagcatccctccgtgagcctcgcctttcctcccgtgggctggcagagaacagtttggcagcctgggcacacaacaacagtctgggagtggctgaaaaccgtggttatgctgaagcatccctggcacttgacatccatgaagaaggagttgggggattggacgaggcgcttcttcttgtgcttgagtttctcgagctctgccggcgggttcagaaggtcgatgtcgttctggagaaccatcttgcctcgggcggcggcggaggagagtgcgtt

SEQ ID NO: 1357 - DNA, 159 bp, Zea mays
atgtccagcttccatgatatgcactcaaagtgtcaagcgatctcactagcattagctaacagtatagccctatttcggcctgcagataataggatctttgcactagaggacatcagtttccttcgtacttcgggtctgccatcacgaagtggtacgcaa

SEQ ID NO: 1358 - DNA, 792 bp, Zea mays
atgcagagccgaaccccgcggcctccgtccgagccgcacgcgcgcacggaagaggcgcgacaagaggccgccgccgcgggtcgtgtcgctcactcgccccagctcgcaggagtacattacagcgcgtcacccgcgcagcgtgatgacgaacgacgacccccatccccattccatccggacatctgctgcaggctgcagtacaaaggcaggcggccagccggcctttcgcgccacctctctctctctctctctcgtttctctacctggaactgggggtggaaatccggcgcgactcgtcgcgggggtgggagacgagcttggcggggtcgcgccaccaaaccacctcgcgctccttctcgtggagccgccgctgcgcgctgtccagtgccgactccagctccacgatccggtcctgctgccgcttctgcagcagctcgtggagccgccgctccagcgcgcgcgccgacacgccgccgtgcgggggactcatcctgtcctcgccgtactccacgtcatcctcctcctcctcctcatcgccgtcgtcgtcctcttcgccctcgccgtccacttcatcattatcgtcgtgcttgtcgcagccaccgccgtcgtagtccacgcagctgcgcgacgcgctgtcgggggcgtcgcccttcgtcttcaccttcagcagcggcaactcgagtcctcgcgtcggggcgatccggctgtcgccgccgtggccgtgcaccaccgtaccgccgcgcccacgctgctgctgcatgcggctcagctcggcctggagctccgcctcca

SEQ ID NO: 1359 - DNA, 555 bp, Zea mays
atgcacacgcagatgcgtgcgtacgcacactgcatgcagccgggctctctgcctctacttggcagccgcgtcgagagtgaggaacgggcgctggccgttgacgttgcccggggggtcgtagctgcagacgatgaagacgccgcggttgtcggcgcagacgacgcgcgcgcagccgatgcgggtggacctgcgccacaccacctgcgtgtagtggccgcacaccttgccggggtcgcaggtgttgctgctcaggtggtagttcctcttctcgtccacccacgaccgcagcgcgtcggcggcgctccacgcccgccccgccgagccccagaagatgttctcgccgaacggcccgcccgagtgcaccagccggcagtccccggcgcgcttcgccgcgtagtcctgcgcgtacctggccaccctggcgtcccacgccaccgggcccacgccgtccgccgcgcgcgcgcggttgtgcagattcacgaagtcctgcggcgtgttctgcgccgaggcggtcgcggccatcatcgccgccgccatggccgcagcgagggcagc

SEQ ID NO: 1360 - DNA, 336 bp, Zea mays
atggtgaagggacgcacgggacagcgcgtcaggctctacgtccggggcaccatcctcggatacaagaggtccaagtcgaaccagtacgagaccacgtcgctcattcagatcgagggggtgaacaccaaggaggacgtcgcgtggtacgctggcaagcgcatggcgtacatctacaaggctaagaccaagagcagcgagacccgctacaggtgcatctggggcaaggtcacccgcccgcacggcaactcgggcgtcgtccgcgccaagttcaagtccaacctcccgcctgagtccatggggcgcaaggtcagagtgttcatgtacccgagcagcatc

SEQ ID NO: 1361 - DNA, 585 bp, Zea mays
atgtatgttaccatggaccgttatgagaatgactgggatgtggttaaacgtggctgggatgctcaggtgctcggagaagcaccctacaaattcaaaagtgcacttgaggctgtgaaaacactgagagcacagcccaatgctaatgaccaatacttgcccccatttgtgatagttgatgacagcggcaaagctgttgggcctgtattagatggtgatgcagttgtcactatcaacttccgggctgatcgcatggttatgcttgctaaagcactagagtatgcagattttaacaattttgaccgtgtacgtgtccccaaaattcgatatgctgggatgcttcagtatgatggtgagttgaagcttccaagtcgctaccttgtttccccaccagagatagatagaacatctggggagtacttggtgaagaatggcatccgcacctttgcttgcagtgagacagtgaaatttggccatgtcacatttttctggaatggtaaccgctcgggatactttgatgaaactaaggaagagtatgtagaagttcctagtgacagtggtattacatttcaatgtttgcacccaaga

SEQ ID NO: 1362 - DNA, 990 bp, Zea mays
  misc_feature (866)..(866): n = any nucleotide
atggcgagcggcggggcggtgagggaggtgggctcggccgccgagctgcaggcggcggtggccggggcgcgggcggcggcggtgcacttctgggcgtcctggtgcgaggcgtccaagcagatggacgaggtcttcgcgcacctcgccgtcgacttcccccacgcggccttcctccgggttgaagctgaagaacaacctgaaatatcagaggcgtatggagttacagcggtgccatattttgttttctgcaaggaaggcaaaactgtcgatactttggagggagcaaacccagccagcttagccaataaggttgcaaaagtagctgggcctgctagtgttgctgagtctgctgtacctgctagccttggagttgctgctggacctgctgtacttgaaaacatccaaaagatggcacagcgaaatggatcttctgctgttgaaagcataagctctggtagcacagaagatgcattgaataagcgattggagcagcttgtcaattcccatcccgtgtttttatttatgaagggaaccccagagcaaccaaggtgtggtttcagccgtaaagtgattgacattttgaagcaggaaggggtgaaatttgggagctttgacattcttacagacaatgatgttcgcgaaggcatgaagaaattctccaactggcccactttccctcaactctactgcaaaggtgagctgcttggtggatgtgatattgttgttgctatgcacgaaagtggtgaattgaaggatgtttttgaggagcacaacattacccttaaaccacagggaagcaaaaatgaagaagcaggtgaacctgagtctgcaactgagaagggcagtgcagtttctgaatcaatcangcttactgatgctcagaaaactcgtttggaaagccttattaactccagccccgtgatggtattcatcaaaggtacccctgaggaacccaaggtgtggttccagtgggaagttggttcacatact

SEQ ID NO: 1363 - DNA, 420 bp, Zea mays
atgagcgccgtggcggtttcgtcgtcgctgaacccggacgcgccgctcttcatcccggcggcgctgctgcaggtggaggacttctcgccgcagtggtgggacctcatcaccaccactgcctggttccgcgaccactggtcccgcgagcgcgcccacctggacgagatggccgagcagatcgacgcggccggcctcctccccgacgacgaggacctcttctacgacgaccagctcgagcagggccccgtcgccgccgcccttaagacagattcggtgctcaaggcgctgaacatgacctccccgaagggcggcggcgacgccccgcgggggttccgggagaaacccaggaacgccgagaagccgaccaagtacgccggcagccccaagagcagcgccccccgcgtgatccaccagcctcgc

SEQ ID NO: 1364 - DNA, 420 bp, Zea mays
atggctgaacaggaggccccagtcgcggttgaggcaccaaccccagttcttggggagcctatggacttgatgactgctctgcagctcgtgataaagaagtcaagtgctcatgacggtcttgtgaagggtctccgtgaggctgccaaggccatcgagaagcacgccgctcagctttgcgtgcttgctgaggactgtgaccagccagattacgtcaagttggtgaaggcactctgcgctgagcacaatgttcacctggtcactgttcctgccgctaagactcttggcgagtgggccgggctttgcaagattgactctgagggcaaggcaaggaaggttgtaggctgctcctgcgtcgtcgtcaaggactacggtgaagaatctgagggccttaacatagtgcaggagtatgtcaagtcgcac

SEQ ID NO: 1365 - DNA, 384 bp, Zea mays
  misc_feature (381)..(381): n = any nucleotide
atggtgactccaggctccgactccaagaaggtgacccctgaggtgattgctgagtacaccgtccgtaccctccagaggaccgtccctgctgctgtgcctgctgttgtcttcctctctggtggacagagcgaggaggaggccacccgcaacctcaatgccatgaacaagctcagcaccaagaagccgtggtccctgtctttctccttcggccgtgccctccaggcgagcaccctcaaggcctgggctggcaaggtggagaacctggtgaaggctagagctgccttccctcgcaggtgcaaggccaactctgaggcttactctggaacctacagggtggatgctgccgacgacacggagagcctccacgttaaggactacaanacc

SEQ ID NO: 1366 - DNA, 777 bp, Zea mays
atgtcgtctgagcctccacccgcctcctctgccgccgccggagaggaactcgctgctgacctttccgccgctaccctcagcaagaagcagcagaagaaggacgcgaggaaggcggagaaggcagagcagcgccagcgtcagcagcagcagcagcagcagccggcggacgccgaggacccgttcgcggccaactacggcgaggtccccgtcgaggagatccagtcaaaggccatctccggccgctcgtggtcccatgtcggcgacctcgacgactccgctgcgggccgctccgtgcttatccgcggagccgcgcaggccatccgtccggtcagcaagaagatggctttcgtcgtgctgcgccagagtatgagcaccgtgcagtgcgtgctcgctgtcagcgccgacgccggtgccagtacgcacatgtgtgcgcttcgccaccgcccctcagtctggagctccacctcccacaaccgacgtgcgtataactcttctcccaaaggacgtccactatggcccaccccacaacaccgtcacccacaatccgtacccctcctctcctcgctctccccagtcagttcttctcactttcctcctttcatccccaatgtcgtaacgtcaacttcaaccacccctctttctttcctttctctccctcttgaatccatgcactcaatctattccttcttcctttctctccctttcgtctccaaccgcccccaatttctctctcccccgcttctccccgccatcccaccacctatatctcactcatcg

SEQ ID NO: 1367 - DNA, 615 bp, Zea mays
atggcgatcgaccacgagtccccgttcaaggagctccgcctcaagaaccgcaggatcatgggcggcggcggccctgaccctgagccggaggaggaggaggaggtcgccacggcggcgtacgcggggcagtggccgcgctggctgcagccgctgctttcggcgcgcttcttcgcgcactgcaggacgcacggcgactcgcaccgcagcggcgagtgcaacatgttctgcctggactgctccgccgcgggcgcgggcgcgggcgcgcgcgccctgtgctcgctgtgcctggcgcaggcccaccgcgaccaccacaccatccagatccggcgctcctcctaccacgacgtcatccgggtgtccgacatccagcgcttcatggacatcgccggggtgcagacctacgtcatcaacagcgcccgcgtcgtcttcctcaacgagcggccccagcagcagaggcctggatgcaaggccgcgtcggcgtccgccaacctctgcgaggtgtgcgcccgcaacctcctcgacaacttccgcttctgctccctcggatgcaaagtcgggggctgctcccccgacgccgacaaggccaggaagctggctcctccggcccgccgtcgg

SEQ ID NO: 1368 - DNA, 636 bp, Zea mays
  misc_feature (518)..(518): n = any nucleotide
atggcaaacgcgccgaggatcctggccctcggcctgctagcgctcctgtgcgctgccgccggcccggccgccgcgcagaactgcggctgccagccaaacttctgctgcagcaagttcggctactgcggcacgaccgacgcctactgcggcgacgggtgccagtcgggcccgtgccgctcgggcggcggcggcggcggcggcggcggcggaggcggcggaggcagtggcggtgcgaacgtggctaatgtggtcaccgacgcgttcttcaacggcatcaagaaccaggccgggagcgggtgcgagggcaagaacttctacacccggagcgcgttcctgagcgccgtcaacgcgtacccgggcttcgcccatggcgggacggaggtggagggcaagcgcgagatcgccgccttcttcgcgcacgtcacgcacgagaccggacatttctgctacatcagcgagatcaacaagagcaacgcctactgcgacgcgagcaacaggcagtggccgtgcgcggcggngcagaagtactacgggcgcggcccgctgcagatctcgtggaactacaactacgggcccgccgggagggacatcggcttcaacgggctcgccgaccccacagggtggcgcaggacgccg

SEQ ID NO: 1369 - DNA, 531 bp, Zea mays
atggatgcatacatacacaggaaggatctggctgagctctgttgctcagcaggcgacgaactggtagtcgacgttgaggtggcccatctggtagccctgcccgttggtgtcgatcttcttgaacaccgtctcgtagtccaggtccaggccgccgttgctgcactggtccacgatcctcgccacgatggacgcgcccgtcgcacggttcttcacccttatgcacttgccgcaggcggcctggcccttctgcccggcgggcccgcagaaggccgtccagccgtgcttctgccgccacgacagcggcttgtcggcgtcccacgtggcgcagtacgcgctcacgcggttcaggtcccacccgttctgcgccgggttgtacaggtggtacgtcgcccgcacgttcgacgcctgctgcgccgccgccatggccgccaccgcgcagagcacgcccgccaccgccagcgccgcccgtcctccggagaccatcatcgccgccgcagcagccatcgtcgttgcctcttttctttgccaaac

SEQ ID NO: 1370 - DNA, 255 bp, Zea mays
atgaaactgagcaccatgcggtccagccccagtgaccccgcggcgtccgcatcgtcggtcgcgggcggcaacggcggcggcggcggcggcagcttctcgtccttgtccctgtccttcccatccgcggcgaacttctccgatgaagacacccgcccgagcagcctccggagcctcgacaccctcggcgtcggcgcaggctgctgcgtcgtcggcggcggcggcggcttctcttccatggcggcgccgtggtggtgg

SEQ ID NO: 1371 - DNA, 495 bp, Zea mays
atggaaactgccgccgtcgccgcctccagtgccgggcgccgcatcatggtggccgtggacgagggcgaggagagcctgcacgcgctcaactggtgcctcgccaacgtcgtctccccggcaggaggcgacacgctggtgctcgtccacgcccgccgcccgcgcccggtctacgccgccatggacagcgcagggtacatgatgacctcggacgtgctggcgagcgttgagaggcacgccaacgcggtctcggcggcggcggtcgacaaggccaagcgcgtctgcgccgaccacccgcacgtcaaggtggagacgacggtggagagcggggacccgcgggacgtcatctgcgacgcagccaacaagatggccgcggacctgctcgtcatgggcagccatggttacggcttcatccagagggcgttcttgggcagcgtcagcaaccactgcgcgcagaactgcaaatgcccggtcctcattgtcaagaggcccaaggag

SEQ ID NO: 1372 - DNA, 567 bp, Zea mays
atggccatcacccacgacgactacgtctccctgtgcctcatggcgctcgcagccgcgggaggaggagggcacgctgcggcagccagtgccaggacgacgacgacaatgacgacgcaagagtgcgagctccgcttccggtgctccgtctgcggcaaggccttcgcgtcgcaccaggcgctgggcgggcacaaggccagccaccggaagccgccgccgccgctcgcacaggcgccgtcgtcgtcgtcgtcggtgacgacgaatacctcgtcggcgggcggcagcggcgccgggcaggggaggcacaggtgctcggtgtgccaccggggcttcgccacggggcaggcgctcggcgggcacaagaggtgccattactgggacgggctctcggtgtcgctcaccgcgtcggcggcgtcggggtccgcgtcgagcttgaggggcttcgatctgaatttggtgccggccgccggcgcggcaaggtggcgagaggaggaagaggtgcagagccccttgccggtcaagaagcggcggctgtcctccggtccttccaccgaacttagtttaacgatt

SEQ ID NO: 1373 - DNA, 432 bp, Zea mays
  misc_feature (311)..(311): n = any nucleotide
  misc_feature (383)..(383): n = any nucleotide
  misc_feature (424)..(424): n = any nucleotide
  misc_feature (429)..(429): n = any nucleotide
atggtccacagcagctcgctgcaccgccgcatggacggccgctcatccctggccgccgcgacgctctgcgctgccagcgccagcgtcctctccgctgcggccaccgacgccgggctccgccgcatcctggggtccatggccaccacggcttcccctgctctgcacttctgcaacgcccatttggtggtgagccgggcctcgccgccgcggctgcgctcgacgggcggccggccggtggctagctccacgaggaggacgccgaaggcgtacacgtcgctcttgtcggtcagctggtacgtgatcaggtactncgggtccacgtacccggcggcgctcctcgcccggggtggcgtccggagcctgagcccgaccccgagggccgnagtccccggccagcccaaagccggccaccttcgccgccagngcgtnggg

SEQ ID NO: 1374 - DNA, 240 bp, Zea mays
atggcggatcagttcgcggattcggcgaacaacgtgatcatcgaggaggtgaacaagggactgaacccaggaatggtggttctgctcgtggttgccagcttcctgctgctcttctttgccgggaactacgcgctgtatgtgtacgcgcagaagacgctcccgccgaagaagaagaagccggtctccaagaagaagctgaagagggaaaagctgaagcagggtgtctccgcgccaggggag

SEQ ID NO: 1375 - DNA, 312 bp, Zea mays
atggacctcatcacgccggaaaggtttgacaacaagtactacgtcggcctgaccaacaacctgggcctcttcaagtcagacgtggcgctgctgaccaacgcgacgatgaaggccctggtcgactccttcgtgcgcagcgaggcgactttcaggaccaagtttgccaggtccatgatcaagatggggcagatcgaggtgctgacggggacgcagggcgagatcaggcgcaactgcagggtcatcaaccccgttagtgccaccgatgatgtcgtcctcgcccgcccatcaggattcactggagtggctgcgagc

SEQ ID NO: 1376 - DNA, 780 bp, Zea mays
  misc_feature (110)..(110): n = any nucleotide
atgtcgtcgaacgccggtagagagcccagctccgggaacgggtcgtcgtcgatctccgatccgggcgtccgcgtgtcggagtgggagtgcgagagcgacgcctccgactnccatcgccttcttctccttctccttctgctgctgcatcttctcccactcgttcttcttgttgtacaggcggcacagcacccagtcatccagcctgagcgtgccggcgccggacttcttggcgcgggcgccgccggcttcggcgaggcggtactcgtgcatgatccactccgtcttgaccccgcgcggcggcttgccgtggtagaacacgagcgccttcttgatccccgccgtccggccctcgtgctccacgggcttgtccgcgcccgtggccttccagtagcccgacccggcggcgcggttggggcgggagccgttggggtacttgcggtcccgcggcgtgaagaagtaccactcgcggcgcccgaagagggcgcgctccggcaggtcccaggggtcgaagcggtacaggtcgacctcggcgatgatggacaccggcgggcggcgccccgcggcgcgcgcgcagaggtagtgcgccaccagctcctcgtccgtcgggtggaaccggaagcccgggggcaggttgagctccgcctccgcgtcgcggcgctgctgctgctgctgctgctgcacggccgccatcgctaccattggacgctttactcgctcgctgtggcctgtgggttggttggttggttcggttgttggctggcggctagctgctgcgggagg

SEQ ID NO: 1377 - DNA, 660 bp, Zea mays
  misc_feature (649)..(649): n = any nucleotide
atggatatggccattgacacgccatcgccggcgccgcccacgccgccggcgccatcggcagcggccgggcggcagacgcgtgcggcagaggcggtgcgtctggagcaccaactggtgcgcgtgcctctcgagtccctccgcgccaccgtccgctcgaaccaccgcctcgccgagaaggagatcgccgccgtcctctcctccgcctccgcggcccccgcagagagcagtgccgccgccgtcgaccacctcacctccctcgtctctcgcctccacggcctcaagcgcaagatggaggagggcgcacgagcggaggaactgcaggtgcagcggtgccgggcgcgtctggaccggctggcgactgccagcaccggcgacgatgccgaatgggaggacatgcggttgaagaggatcctggtcgattacatgcttcggatgtcctactacaattccgccaccaagctcgctgagacttctggtattcaggacctcgttgatattgatgtctttctcgatgcgaaaagagtaattgattctcttcagaataatgaagtttctcctgctttagcttggtgtgcagaaaacaagtctcggctaaagaaatcgaagagtaagcttgagtttttactgaggcttcaagagtttgtgggantttgtcaaggt

SEQ ID NO: 1378 - DNA, 825 bp, Zea mays
  misc_feature (270)..(270): n = any nucleotide
atggtgtataaggggacgctgtccaccggcgtggagatcgccgtggtgtccaccaccaagaactctgccaaggagtggtccaagcactgcgagtcacaattcaggaagaagataacaagcctgtccagagtgaaccacaagaacttcgtcaacctgctgggctactgccaggaagagcagccgtttacgaggatgatggtgttcgagtacgctccaaacggcacgctcttcgagcatctgcacgtcagagaagacggttacctggactgngccactcgcctgcgcgtggcggtcggcgtcgcctactgcctggagcacatgcaccagctgagcccgccggagattctgcgggcgctggacacgtcccccatctccttcaccgacgattcgcggccagaatctccgacgtcgtcttctgcgacgagcccgactgccaggagggaagcctgtccctgtcgcgcctgtcggaccggaagacgcgtggtgtacagctaccggatggtgctgctggagaccatgaccggacggttcacggcgtcagctggcggcatgctagaggcctgggccgcggcctacttagaggggaggcggcagctccggcacgtgatggatcccgccctgcggcggtccttccacgccgccaccgtggacaggctggacggcgtcatcaggggctgcaccgaccgggagcccaggaggcggctgaccatagcggaggtcgccaagcgcctgagggagatcactgccatgtcacccgacgcggccacccccaaggtttcgccgctgtggtgggcggagctggagatcatctgcgcagaggtcaac

SEQ ID NO: 1379 - DNA, 459 bp, Zea mays
atgctggtcatcgaggcctaccgcacgctgcgcgaccgcgggccctacccggccgaccaggtcgtcaaggacctcgccggcgccttcgccttcgtcgtcttcgacagccgctccggcgccgtcttcgccgccctcggcgccgccgacgccgggggagcgccggtgccgctgtactggggcgtcgcggccgacgggtccgcggtgatcagcgacgaccgggacctggtcaagcgcggctgcggcaagtcctacgcgcccttccccgcgggctgcatgttccacagcgacggagggctcaagagcttcgagcaccccatgaacaggctcaaggccatgccgcgcgtcgacagcgagggcgccatgtgcggcgccaccttcaaggtcgacaccttcaccaagatcaactccatgccccgtgttggcagcgccgccaactgggccgcctgggacgaagccatc

SEQ ID NO: 1380 - DNA, 528 bp, Zea mays
atgcgcgccgaggccggcgacggtggcccggcgccgccgctcacctacgagcacctcaagcgcatgcactacacccacgcggtgctgtacgagaacatgcggctgttcccgccggtgcagttcgactccaagttctgcgtggggccagacgtgctccccgacggcacctacgtgccgggcggcacgcgcgtgacctaccacccctacgccatgggccgcatgccgcgcatctggggcgccgaccacggcgccttccgcccgggccgctggctcaccggcgccggcggctcgttcgtccccgagagcctgtacaagtacccggtgttccaggcgggccttcgcgtgtgcctcggcaaggagctcgccgtcaccgagatgaaggcggtcgcggtggccgtcgtgagggcgttcgacgtccacgtcgtcggggacagtggcagcgccgcctgcaagccgaagttcgtgtcggggctcaccgcgtccatcagcggcgggctcccggtgaggatcagtagacgagttcgaagc

SEQ ID NO: 1381 - DNA, 321 bp, Zea mays
atgctgtcagcctgtgctctggtctcaaagacatggattgaagtttccggttcatcagcaaaggatgttgctaagcagctcaaggaacaacaaatggtgatgccaggccatcgtgagtcgaacttgcagaaggaacttaaccgatacatccccactgctgctgcatttggtggtgtatgcattggcgcattgaccgtcctggctgatttcatgggtgcgattggttcaggaactggtatattgctcgctgtgacaatcatataccaatacttcgaaacctttgagaaggaaagggcgactgagcttggtttctttggtttt

SEQ ID NO: 1382 - DNA, 195 bp, Zea mays
atggacacccaggtgaagcttgctgttgtggtgaaggtgatgggcaggaccggctccaggggtcaggtgacccaggtcagagtgaagtttttggatgaccagaaccggctcatcatgaggaatgtcaaggggcccgttcgcgagggtgacatcctcaccctgctcgagtccgagagggaggccaggaggctgcgc

SEQ ID NO: 1383 - DNA, 609 bp, Zea mays
atgttgggttttattcatctaaaggaaggccccgcgttttacaacgacgtcggtctttgcatctgcctgcctgcatgcatggatgcatacatacacaggaaggatctggctgagctctgttgctcagcaggcgacgaactggtagtcgacgttgggggggcccatctggtagccctgcccgttggtgtcgatcttcttgaacaccgtctcgtagtccaggtccaggccgccgttgctgcactggtccacgatcctcgccacgatggacgcgcccgtcgcacggttcttcacccttatgcacttgccgcaggcggcctggcccttctgcccggcgggcccgcagaaggccgtccagccgtgcttctgccgccacgacagcggcttgtcggcgtcccacgtggcgcagtacgcgctcacgcggttcaggtcccacccgttctgcgccgggttgtacaggtggtacgtcgcccgcacgttcgacgcctgctgcgccgccgccatggccgccaccgcgcagagcacgcccgccaccgccagcgccgcccgtcctccggagaccatcatcgccgccgcagcagccatcgtcgttgcctcttttctttgccaaac

SEQ ID NO: 1384 - DNA, 1065 bp, Zea mays
atgtacactgcaatggcagcgcgaccgctgcttcttccccctccggtcctcctcctcctggtggtgctggctgcttcgtcggccgcccatggctacggcgcctacggctacggcgacgctgctgctgagctcagggtcgggttctacaaggactcgtgcccggacgccgaggccgtcgtccgcaggatcgtcgccaaggccgtccaagaggaccccacggccaacgcgccgctgctcaggctccacttccacgactgcttcgtccggggctgcgacggctccgtgctcgtcaactccaccagggggaacacggcggagaaggacgccaagcccaaccacacgctggacgccttcgacgtcatcgacgacatcaaggaggcgctggagaagcgctgcccggggaccgtctcctgcgccgacatcctcgccatcgccgccagggacgccgtctcgctggccaccaaggtggtgaccaagggcggctggagcagggacggcaacctctaccaggtggagaccggcaggcgggacggccgcgtgtccagagccaaggaggccgtcaagaacttgccggactccatggatggcatccgcaagctcatcaggaggttcgcttccaagaacctcagcgtcaaggatctcgctgttctctcaggcgcccacgcgatcggcaaatcgcactgcccgtcgatcgccaagcggctgcgcaacttcacggcgcaccgggacagcgacccgaccctggacggcgcgtacgcggcggagctgaggcggcagtgccggaggcgcagggacaacacgacggagctggagatggtgccggggagctccaccgcgttcggcacggcctactacggcctggtcgcggagcggagggcgctcttccactccgacgaggcgctgctcaggaacggggagaccagggcgctcgtctaccgctatagggacgcgccgtccgaggcggcgttcctcgcggacttcggggcgtccatgctcaacatgggcagggtgggcgtgctcaccggcgcccagggggagatcaggaagaggtgcgcctttgtcaac

SEQ ID NO: 1385 - DNA, 342 bp, Zea mays
atgatggcgatgccgaccgcggacgccaccgagttgacggtggaggtgaggcgcgcgccggacacggcgagcgcggaagtggcgcacagcacgacgacggcgatcgggtccagcagattgaagccgtcggcgagcgcggggacgtggatgcggagcgcgtcgctgtcgcggccgatgagcgccgcgaggtacgacgtccaggaccggcccaggccggccgcgcccaccacggcctcgagcaggatgttcccggcggcgatgaacgcggccaggtccccgagctcgacgcgcaggtacgagaacgagccgccagccgacgggatctcgccggcgagctccgcg

SEQ ID NO: 1386 - DNA, 390 bp, Zea mays
atggcgcgcggcgtggtgtcggcgaagggcggcgcggtcgcgggcaagaagaaggggtcggtttccttcacgatcgactgcaccaagccagtggaggacaagatcatggaggtcgcctcgctcgagaagttcctgcaggagcgcatcaaggtcgccggcggcaaggctggcaacctcggcgactccgtcaccatctctcgcgagaagaccaaggtcaccgtcacctctgacggacccttctccaagaggtacctgaagtacttgaccaagaagtacttgaagaagcacaacgtgcgggattggctacgcgtggttgctgccaacaaggaccgaaacgtctatgagctccgctacttcaacattgctgagaacgagggcgaggaagaagat

SEQ ID NO: 1387 - DNA, 690 bp, Oryza sativa
  CDS (1)..(687)
atggagcacagcttcaaaaccataacagctggagtggtgttcgtcgtgctgctcctgcagcaggcgcccgtgctgattcgggccaccgacgcggaccctctccaggacttctgcgtcgccgacctcgacagcaaggtcacggtgaacgggcacgcgtgcaagccggcctcggcggccggcgacgagttcctcttctcgtctaagatagccacgggcggcgacgtgaacgccaacccgaacggctccaacgtcacggagctcgacgtcgccgagtggcccggcgtcaacacgctcggcgtgtccatgaaccgcgtcgacttcgcgcccggcggcaccaacccgccgcacgtccacccgcgcgccactgaggtcggcatcgtgctccgcggcgagctcctcgtcggcatcatcggtaccctcgacatggggaacaggtactattccaaggtggtccgtgcaggcgagacgtttgtcatcccgagagggctcatgcacttccagttcaatgtcggcaagacggaggccaccatggtggtgtccttcaacagtcagaaccctggcatcgtcttcgtcccgctcacattgtttggctccaacccgcccatcccgacgccggtgctcgttaaggcgctgcgtgtggacactggcgtagttgagctgctcaagtctaagttcaccggtgggtactaa

SEQ ID NO: 1388 - protein, 229 aa, Oryza sativa
MEHSFKTITAGVVFVVLLLQQAPVLIRATDADPLQDFCVADLDSKVTVNGHACKPASAAGDEFLFSSKIATGGDVNANPNGSNVTELDVAEWPGVNTLGVSMNRVDFAPGGTNPPHVHPRATEVGIVLRGELLVGIIGTLDMGNRYYSKVVRAGETFVIPRGLMHFQFNVGKTEATMVVSFNSQNPGIVFVPLTLFGSNPPIPTPVLVKALRVDTGVVELLKSKFTGGY

SEQ ID NO: 1389 - DNA, 690 bp, Oryza sativa
  CDS (1)..(687)
  misc_feature (588)..(588): n = a, t, g , or c
atggagcacagcttcaaaaccataacagctggagtggtgttcgtcgtgctgctcctgcagcaggcgcccgtgctgattcgggccaccgacgcggaccctctccaggacttctgcgtcgccgacctcgacagcaaggtcacggtgaacgggcacgcgtgcaagccggcctcggcggccggcgacgagttcctcttctcgtctaagatagccacgggcggcgacgtgaacgccaacccgaacggctccaacgtcacggagctcgacgtcgccgagtggcccggcgtcaacacgctcggcgtgtccatgaaccgcgtcgacttcgcgcccggcggcaccaacccgccgcacgtccacccgcgcgccactgaggtcggcatcgtgctccgcggcgagctcctcgtcggcatcatcggtaccctcgacatggggaacaggtactattccaaggtggtccgtgcaggcgagacgtttgtcatcccgagagggctcatgcacttccagttcaatgtcggcaagacggaggccaccatggtggtgtccttcaacagtcagaaccctggcatcgtcttcgtcccgctcacattgttnggctccaacccgcccatcccgacgccggtgctcgttaaggcgctgcgtgtggacactggcgtagttgagctgctcaagtctaagttcaccggtgggtactaa

SEQ ID NO: 1390 - protein, 229 aa, Oryza sativa
  misc_feature (196)..(196): The 'Xaa' at location 196 stands for Leu, or Phe.
MEHSFKTITAGVVFVVLLLQQAPVLIRATDADPLQDFCVADLDSKVTVNGHACKPASAAGDEFLFSSKIATGGDVNANPNGSNVTELDVAEWPGVNTLGVSMNRVDFAPGGTNPPHVHPRATEVGIVLRGELLVGIIGTLDMGNRYYSKVVRAGETFVIPRGLMHFQFNVGKTEATMVVSFNSQNPGIVFVPLTLXGSNPPIPTPVLVKALRVDTGVVELLKSKFTGGY

SEQ ID NO: 1391 - DNA, 30 bp, Oryza sativa
tcatttcctggtcctctgtagaagatagct

SEQ ID NO: 1392 - DNA, 30 bp, Oryza sativa
ccgttggtgggcttcaaatgaggtctaaag

SEQ ID NO: 1393 - DNA, 17 bp, Oryza sativa
ggatccgccgccccatg

SEQ ID NO: 1394 - DNA, 63 bp, Oryza sativa
ggccagtgaattgtaatacgactcactatagggaggcggtttttttttttttttttttttttt

What is claimed is:

1. A method of augmenting a plant genome comprising:
   (a) introducing into a plant cell an expression cassette comprising a promoter operably linked to an isolated polynucleotide selected from the group consisting of:
      (i) a nucleic acid comprising the nucleotide sequence of SEQ ID NO: 427;
      (ii) a nucleic acid comprising an open reading frame encoding a protein comprising the polypeptide sequence of SEQ ID NO: 428; and
      (iii) a nucleic acid comprising a nucleotide sequence that is the complement of any one of (i)-(ii);
   so as to yield at least one transformed plant cell; and
   (b) regenerating the at least one transformed plant cell to provide a differentiated transformed plant, wherein the differentiated transformed plant expresses the open reading frame in the cells of the differentiated transformed plant.

2. A method to confer increased resistance or tolerance to a plant pathogen, comprising:
   (a) introducing into a plant cell an expression cassette comprising a promoter operably linked to an isolated polynucleotide selected from the group consisting of:
      (i) a nucleic acid comprising the nucleotide sequence of SEQ ID NO: 427;
      (ii) a nucleic acid comprising an open reading frame encoding a protein comprising the polypeptide sequence of SEQ ID NO: 428; and
      (iii) a nucleic acid comprising a nucleotide sequence that is the complement of any one of (i)-(ii);
   so as to yield at least one transformed plant cell comprising the expression cassette; and
   (b) regenerating the at least one transformed plant cell to provide a differentiated transformed plant, wherein the differentiated transformed plant expresses the isolated polynucleotide in an amount which confers increased resistance or tolerance to the plant pathogen in the differentiated transformed plant compared to a corresponding plant which does not comprise the expression cassette.

3. A method to confer increased resistance or tolerance to a plant pathogen, comprising:
   (a) introducing into a plant cell an isolated polynucleotide selected from the group consisting of:
   (i) a nucleic acid comprising the nucleotide sequence of SEQ ID NO: 427;
   (ii) a nucleic acid comprising an open reading frame encoding a protein comprising the polypeptide sequence of SEQ ID NO: 428; and
   (iii) a nucleic acid comprising a nucleotide sequence that is the complement of any one of (i)-(ii);
   so as to yield at least one transformed plant cell comprising the isolated polynucleotide; and
   (b) regenerating the at least one transformed plant cell to provide a differentiated transformed plant, wherein the differentiated transformed plant expresses the isolated polynucleotide in an amount which confers increased resistance or tolerance to the plant pathogen in the differentiated transformed plant compared to a corresponding plant which does not comprise the isolated polynucleotide.

4. The method of claim 1, wherein the plant cells are cereal cells.

5. The method of claim 1, wherein the plant cells are potato cells, wheat cells, rice cells, corn cells, oat cells, barley cells, soybean cells, alfalfa cells, sunflower cells, canola cells, cotton cells, peanut cells, sorghum cells, tobacco cells, sugarbeet cells or rye cells.

6. A transformed plant prepared by the method of claim 1.

7. A transgenic plant displaying an enhanced disease resistance phenotype comprising an isolated polynucleotide selected from the group consisting of:
   (a) a nucleic acid comprising the nucleotide sequence of SEQ ID NO: 427;
   (b) a nucleic acid comprising an open reading frame encoding a protein comprising the polypeptide sequence of SEQ ID NO: 428; and
   (c) a nucleic acid comprising a nucleotide sequence that is the complement of any one of (a)-(b).

8. The transgenic plant of claim 7, which is a cereal plant.

9. The transgenic plant of claim 7, which is a potato, wheat, rice, corn, oat, barley, soybean, alfalfa, sunflower, canola, cotton, peanut, sorghum, tobacco, sugarbeet or rye plant.

10. The transgenic plant of claim 7, which produces a product.

11. The transgenic plant of claim 10, wherein the product is selected from the group consisting of a seed, fruit, vegetable, transgenic plant, progeny plant, and products of the progeny plant.

* * * * *